United States Patent
Sainson et al.

(10) Patent No.: US 9,957,323 B2
(45) Date of Patent: May 1, 2018

(54) ANTI-ICOS ANTIBODIES

(71) Applicant: KYMAB LIMITED, Cambridge (GB)

(72) Inventors: Richard Charles Alfred Sainson, Cambridge (GB); Stephen John Arkinstall, Cambridge (GB); Jamie Iain Campbell, Cambridge (GB); Mohammed Hanif Ali, Cambridge (GB); E-Chiang Lee, Cambridge (GB); Matthew John McCourt, Cambridge (GB); Nikole Sandy, Cambridge (GB); Cassandra Van Krinks, Cambridge (GB); Volker Germaschewski, Cambridge (GB); Ian Kirby, Cambridge (GB); Miha Kosmac, Cambridge (GB); Thomas Gallagher, Cambridge (GB); Cecilia Deantonio, Cambridge (GB); Stephen D. Gillies, Carlisle, MA (US)

(73) Assignee: Kymab Limited (GB)

( * ) Notice: Subject to any disclaimer, the term of this patent is extended or adjusted under 35 U.S.C. 154(b) by 0 days. days.

(21) Appl. No.: 15/698,600

(22) Filed: Sep. 7, 2017

(65) Prior Publication Data

US 2018/0066058 A1    Mar. 8, 2018

Related U.S. Application Data

(63) Continuation of application No. PCT/GB2017/052352, filed on Aug. 9, 2017, which is a continuation of application No. 15/480,525, filed on Apr. 6, 2017, which is a continuation of application No. 15/354,971, filed on Nov. 17, 2016, now Pat. No. 9,617,338.

(30) Foreign Application Priority Data

| Aug. 9, 2016 | (GB) | 1613683.0 |
|---|---|---|
| Sep. 7, 2016 | (GB) | 1615224.1 |
| Sep. 9, 2016 | (GB) | 1615335.5 |
| Dec. 1, 2016 | (GB) | 1620414.1 |
| Dec. 20, 2016 | (GB) | 1621782.0 |
| Feb. 13, 2017 | (GB) | 1702338.3 |
| Feb. 13, 2017 | (GB) | 1702339.1 |
| Feb. 24, 2017 | (GB) | 1703071.9 |
| Jun. 20, 2017 | (GB) | 1709818.7 |
| Jun. 20, 2017 | (TW) | 106120562 |
| Jun. 20, 2017 | (TW) | 106120563 |
| Jun. 20, 2017 | (TW) | 106120564 |
| Jun. 20, 2017 | (WO) | PCT/GB2017/051794 |
| Jun. 20, 2017 | (WO) | PCT/GB2017/051795 |
| Jun. 20, 2017 | (WO) | PCT/GB2017/051796 |

(51) Int. Cl.
C07K 16/28 (2006.01)
A61K 39/395 (2006.01)
C07K 16/46 (2006.01)
C07K 14/55 (2006.01)

(52) U.S. Cl.
CPC .......... *C07K 16/2827* (2013.01); *C07K 14/55* (2013.01); *C07K 16/28* (2013.01); *C07K 16/468* (2013.01); *C07K 2317/31* (2013.01); *C07K 2317/56* (2013.01); *C07K 2317/565* (2013.01); *C07K 2317/76* (2013.01); *C07K 2317/92* (2013.01); *C07K 2319/30* (2013.01)

(58) Field of Classification Search
None
See application file for complete search history.

(56) References Cited

U.S. PATENT DOCUMENTS

| 5,869,046 | A | 2/1999 | Presta et al. |
|---|---|---|---|
| 6,121,022 | A | 9/2000 | Presta et al. |
| 6,803,039 | B2 | 10/2004 | Tsuji et al. |
| 7,030,225 | B1 | 4/2006 | Tamatani et al. |
| 7,045,615 | B2 | 5/2006 | Tamatani et al. |
| 7,125,551 | B2 | 10/2006 | Kroczek |
| 7,132,099 | B2 | 11/2006 | Kroczek |
| 7,166,283 | B2 | 1/2007 | Tsuji et al. |
| 7,196,175 | B2 | 3/2007 | Tamatani et al. |
| 7,226,909 | B2 | 6/2007 | Tamatani et al. |
| 7,259,247 | B1 | 8/2007 | Kroczek |
| 7,279,560 | B2 | 10/2007 | Tamatani et al. |
| 7,306,800 | B2 | 12/2007 | Kroczek |
| 7,438,905 | B2 | 10/2008 | Suzuki et al. |

(Continued)

FOREIGN PATENT DOCUMENTS

| EP | 0984023 A1 | 3/2000 |
|---|---|---|
| EP | 1125585 A1 | 8/2001 |

(Continued)

OTHER PUBLICATIONS

Alexandrov LB, et al. Signatures of mutational processes in human cancer. Nature. Aug. 22, 2013;500(7463):415-21.

(Continued)

*Primary Examiner* — Ilia I Ouspenski

(74) *Attorney, Agent, or Firm* — Finnegan, Henderson, Farabow, Garrett & Dunner, LLP

(57) ABSTRACT

Antibodies that bind ICOS (Inducible T cell Co-Stimulator). Therapeutic use of anti-ICOS antibodies for modulating the ratio between regulatory T cells and effector T cells, to stimulate the immune system of patients, including use in treating cancers. Methods of producing anti-ICOS antibodies, including species cross-reactive antibodies, using transgenic knock-out mice.

26 Claims, 61 Drawing Sheets

(56) References Cited

U.S. PATENT DOCUMENTS

| | | | |
|---|---|---|---|
| 7,465,445 B2 | 12/2008 | Tezuka et al. | |
| 7,722,872 B2 | 5/2010 | Kroczek | |
| 7,794,710 B2 * | 9/2010 | Chen | A61K 39/0011 424/130.1 |
| 7,932,358 B2 | 4/2011 | Tamatani et al. | |
| 7,988,965 B2 | 8/2011 | Tsuji et al. | |
| 7,998,478 B2 | 8/2011 | Tezuka et al. | |
| 8,318,905 B2 | 11/2012 | Kroczek | |
| 8,389,690 B2 | 3/2013 | Tamatani et al. | |
| 8,840,889 B2 | 9/2014 | Chen | |
| 8,916,155 B2 | 12/2014 | Kroczek | |
| 9,376,493 B2 | 6/2016 | Faget et al. | |
| 9,567,399 B1 | 2/2017 | Campbell et al. | |
| 9,617,338 B1 | 4/2017 | Campbell et al. | |
| 2002/0156242 A1 | 10/2002 | Tamatani et al. | |
| 2010/0203056 A1 | 8/2010 | Irving et al. | |
| 2011/0065902 A1 | 3/2011 | Sleeman et al. | |
| 2015/0239978 A1 | 8/2015 | Marodon et al. | |
| 2015/0307620 A1 | 10/2015 | Vella et al. | |
| 2016/0002336 A1 | 1/2016 | Chen | |
| 2016/0024211 A1 | 1/2016 | Chen | |
| 2016/0145344 A1 | 5/2016 | Akbari | |
| 2016/0215059 A1 | 7/2016 | Liu et al. | |
| 2016/0264666 A1 | 9/2016 | Faget et al. | |
| 2016/0304610 A1 | 10/2016 | Sazinsky et al. | |

FOREIGN PATENT DOCUMENTS

| | | |
|---|---|---|
| EP | 1158004 A2 | 11/2001 |
| EP | 1374901 A1 | 1/2004 |
| EP | 1502920 A2 | 2/2005 |
| EP | 1286668 B1 | 4/2005 |
| EP | 1740617 B1 | 10/2013 |
| EP | 2691419 B1 | 11/2016 |
| WO | WO-1998/003821 A2 | 1/1998 |
| WO | WO 99/15553 | 4/1999 |
| WO | WO-2001/087981 A2 | 11/2001 |
| WO | WO-2005/103086 A1 | 11/2005 |
| WO | WO 2006/133396 A2 | 12/2006 |
| WO | WO-2007/005874 A2 | 1/2007 |
| WO | WO-2008/137915 A2 | 11/2008 |
| WO | WO-2010/036959 A2 | 4/2010 |
| WO | WO-2010/056804 A1 | 5/2010 |
| WO | WO-2010/077634 A1 | 7/2010 |
| WO | WO-2010/089411 A2 | 8/2010 |
| WO | WO-2011/004192 A1 | 1/2011 |
| WO | WO-2011/020024 A2 | 2/2011 |
| WO | WO 2011/041613 A2 | 4/2011 |
| WO | WO-2011/066389 A1 | 6/2011 |
| WO | WO 2011/071871 A1 | 6/2011 |
| WO | WO-2011/097477 A1 | 8/2011 |
| WO | WO-2011/158009 A1 | 12/2011 |
| WO | WO-2012/131004 A2 | 10/2012 |
| WO | WO-2012/145493 A1 | 10/2012 |
| WO | WO-2012/174338 A2 | 12/2012 |
| WO | WO-2013/061078 A1 | 5/2013 |
| WO | WO-2013/061098 A2 | 5/2013 |
| WO | WO-2013/079174 A1 | 6/2013 |
| WO | WO-2013/173223 A1 | 11/2013 |
| WO | WO-2013/181634 A2 | 12/2013 |
| WO | WO-2014/033327 A1 | 3/2014 |
| WO | WO-2014/055897 A2 | 4/2014 |
| WO | WO-2014/089113 A1 | 6/2014 |
| WO | WO-2014/100079 A1 | 6/2014 |
| WO | WO-2014/159562 A1 | 10/2014 |
| WO | WO-2014/165082 A2 | 10/2014 |
| WO | WO-2015/040401 A1 | 3/2015 |
| WO | WO-2015/061668 A1 | 4/2015 |
| WO | WO-2015/109124 A2 | 7/2015 |
| WO | WO-2015/112805 A1 | 7/2015 |
| WO | WO 2015/112900 A1 | 7/2015 |
| WO | WO-2015/136541 A2 | 9/2015 |
| WO | WO-2015/173267 A1 | 11/2015 |
| WO | WO-2015/179654 A1 | 11/2015 |
| WO | WO-2015/181342 A1 | 12/2015 |
| WO | WO-2016/000619 A1 | 1/2016 |
| WO | WO-2016/007235 A1 | 1/2016 |
| WO | WO-2016/022630 A1 | 2/2016 |
| WO | WO-2016/061142 A1 | 4/2016 |
| WO | WO-2016/111645 A1 | 7/2016 |
| WO | WO-2016/120789 A1 | 8/2016 |
| WO | WO-2016/149201 A2 | 9/2016 |
| WO | WO-2016/154177 A2 | 9/2016 |
| WO | WO-2016/160792 A1 | 10/2016 |
| WO | WO-2016/197367 A1 | 12/2016 |
| WO | WO-2017/020291 A1 | 2/2017 |
| WO | WO-2017/020801 A1 | 2/2017 |
| WO | WO-2017/020858 A1 | 2/2017 |
| WO | WO-2017/034916 A1 | 3/2017 |
| WO | WO 2017/070423 A1 | 4/2017 |

OTHER PUBLICATIONS

Beier KC, et al. Induction, binding specificity and function of human ICOS. Eur J Immunol. Dec. 2000;30(12):3707-17.

Bos et al., Transient regulatory T cell ablation deters oncogene-driven breast cancer and enhances radiotherapy, J Exp Med 210(11):2434-2446 2013.

Carthon, B.C., et al. Preoperative CTLA-4 blockade: Tolerability and immune monitoring in the setting of a presurgical clinical trial. Clin. Cancer Res. 16:2861-2871.

Chattopadhyay et al., Structural Basis of Inducible Costimulatory Ligand Function: Determination of the Cell Surface Oligomeric State and Functional Mapping of the Receptor Binding Site of the Protein, J. Immunol. 177(6):3920-3929 2006.

Conrad C, Gilliet M. Plasmacytoid dendritic cells and regulatory T cells in the tumor microenvironment: A dangerous liaison. Oncoimmunology. May 1, 2013;2(5):e2388.

Coyle AJ, et al. The CD28-related molecule ICOS is required for effective T cell-dependent immune responses. Immunity. Jul. 2000;13(1):95-105.

Crotty S. T follicular helper cell differentiation, function, and roles in disease. Immunity. Oct. 16, 2014;41(4):529-42.

Curran et al., PD01 and CTLA-4 combination blockade expands infiltrating T cells and reduces regulatory T and myeloid cells within B16 melanoma tumours, PNAS 107(9):4275-4280 2010.

Dall et al., Increasing the affinity of a human IgG1 for the neonatal Fc receptor : Biological consequences. Immunol 2002; 169:5171-5180.

Fan X, Quezada SA, Sepulveda MA, Sharma P, Allison JP. Engagement of the ICOS pathway markedly enhances efficacy of CTLA-4 blockade in cancer immunotherapy. J Exp Med. Apr. 7, 2014;211(4):715-25.

Fu T, He Q, Sharma P. The ICOS/ICOSL pathway is required for optimal antitumor responses mediated by anti-CTLA-4 therapy. Cancer Res. Aug. 15, 2011;71(16):5445-54.

Galluzzi et al, Immunological mechanisms underneath the efficacy of cancer therapy. Canc. Imm. Res. 4:895-902 2016.

Gül et al., "Antibody-Dependent Phagocytosis of Tumor Cells by Macrophages: A Potent Effector Mechanism of Monoclonal Antibody Therapy of Cancer", Cancer Res., 75(23), Dec. 1, 2015.

Hänzelmann, et al., "GSVA: gene set variation analysis for microarray and RNA-Seq data," BMC Bioinformatics, vol. 14, No. 1, p. 7, 2013.

Hodi FS, et al., Immunologic and clinical effects of antibody blockade of cytotoxic T lymphocyte-associated antigen 4 in previously vaccinated cancer patients. PNAS Feb. 26, 2008;105(8):3005-10.

Houot et al., Therapeutic effect of CD137 immunomodulation in lymphoma and its enhancement by Treg depletion, Blood 114:3431-3438 2009.

Idusogie et al., Engineered antibodies with increased activity to recruit complement. J. Immunol., 2001, 166:2571-2575.

Langer, New methods of drug delivery. (1990) Science 249:1527-1533.

(56) References Cited

OTHER PUBLICATIONS

Lazar et al., Engineered antibody Fc variants with enhanced effector function 2006, Proc. Natl. Acad. Sci. U.S.A., Mar. 14; 103(11):4005-10.
Liakou CI, et al. CTLA-4 blockade increases IFNgamma-producing CD4+ICOShi cells to shift the ratio of effector to regulatory T cells in cancer patients. Proc Natl Acad Sci U S A. Sep. 30, 2008;105(39)14987-92.
Martin-Orozco et al., Melanoma Cells Express ICOS Ligand to Promote the Activation and Expansion of T-Regulatory Cells, Cancer Research 70(23):9581-9590 2010.
Nair et al., A simple practice guide for dose conversion between animals and human. J Basic Clin Pharma 2016;7:27-31.
Natsume et al., 2008, Engineered Antibodies of IgG1/IgG3 Mixed Isotype with Enhanced Cytotoxic Activities. Cancer Res., 68: 3863-3872.
Preston CC, et al., The ratios of CD8+ T cells to CD4+CD25+ FOXP3+ and FOXP3—T cells correlate with poor clinical outcome in human serous ovarian cancer. PLoS One Nov. 14;8(11):e80063.
Selby, M.J. et al., Anti-CTLA-4 antibodies of IgG2a isotype enhance antitumor activity through reduction of intratumoral regulatory T cells. Cancer immunology research, 1(1):32-42 2013.
Shields et al., High resolution mapping of the binding site on human IgG1 for Fc gamma RI, Fc gamma RII, Fc gamma RIII, and FcRn and design of IgG1 variants with improved binding to the Fc gamma R. 2001, J. Biol. Chem., Mar. 2; 276(9):6591-604).
Shields et al. Lack of Fucose on Human IgG1 N-Linked Oligosaccharide Improves Binding to Human FcyRIII and Antibody-dependent Cellular Toxicity (2002) JBC 277:26733.
Sim et al., IL-2 therapy promotes suppressive ICOS+ Treg expansion in melanoma patients, J Clin Invest 2014.
Sim et al., IL-2 variant circumvents ICOS+ regulatory T cell expansion and promotes NK cell activation, Cancer Immunol Res 2016.
Simpson et al., Fc-dependent depletion of tumor-infiltrating regulatory T cells co-defines the efficacy of anti-CTLA-4 therapy against melanoma. J. Exp. Med. 210(9):1695-1710 2013.
Strohl, Fusion Proteins for Half-Life Extension of Biologics as a Strategy to Make Biobetters. BioDrugs (2015) 29:215-239.
Swallow MM, Wallin JJ, Sha WC. B7h, a novel costimulatory homolog of B7.1 and B7.2, is induced by TNFalpha. Immunity. Oct. 1999;11(4):423-32.
Vonderheide, R.H., et al. 2010. Tremelimumab in combination with exemestane in patients with advanced breast cancer and treatment-associated modulation of inducible costimulator expression on patient T cells. Clin. Cancer Res. 16:3485-3494.
Wang S, et al. Costimulation of T cells by B7-H2, a B7-like molecule that binds ICOS. Blood. Oct. 15, 2000;96(8):2808-13.
Yusa K, et al. A hyperactive piggyBac transposase for mammalian applications, Proc Nall Acad Sci U S A. Jan. 25, 2011.
Barbie, et al., Systematic RNA interference reveals that oncogenic KRAS-driven cancers require TBK1., Nature, 2009; 462(7269)108-12, plus 22 pages supplemental materials.
Baruch K. et al. PD-1 immune checkpoint blockade reduces pathology and improves memory in mouse models of Alzheimer's disease. Nat Med, 2016; 22(2):135-9, plus 296 pages supplemental material.
Dong C, et al. ICOS co-stimulatory receptor is essential for T-cell activation and function. Nature. 2001; 409(6816):97-101.
French et al. What is conservative substitution? J. Mol. Evol. 1983; 19;171-5.
Hutloff A, et al. ICOS is an inducible T-cell co-stimulator structurally and functionally related to CD28. Nature. 1999; 397(6716):263-6.
Kilpatrick et al., Rapid development of affinity matured monoclonal antibodies using RIMMS; Hybridoma, 1997; 16(4):381-9.
Kroemer et al. Immunologic Cell Death in Cancer Therapy, Ann Rev Immunol. 2013; 31:51-72.
Lee et al, Complete humanization of the mouse immunoglobulin loci enables efficient therapeutic antibody discovery. Nature Biotechnology, 2014; 32:6-363.
Lefranc MP, IMGT unique numbering for immunoglobulin and T cell receptor variable domains and Ig superfamily V-like domains, Dev Comp Immunol. 2003; 27(1):55-77.
Mak TW, et al.. Costimulation through the inducible costimulator ligand is essential for both T helper and B cell functions in T cell-dependent B cell responses. Nat Immunol. 2003; 4(8):765-72.
Natsume et al., Improving effector functions of antibodies for cancer treatment : Enhancing ADCC and CDC, 2009, Drug Des. Devel. Ther., 3:7-16.
Powell et al. "Compendium of excipients for parenteral formulations" PDA J Pharm Sci Technol, 1998; 52:238-311.
Rubio V., et al. Ex vivo identification, isolation and analysis of tumor-cytolytic T cells. Nat Med. 2003;9(11):1377-82, plus 9 pages supplemental material.
Sato et al., Spatially selective depletion of tumor-associated regulatory T cells with near-infrared photoimmunotherapy, Science Translational Medicine, 2016; 8(352):1-12, plus 27 pages supplemental material.
Taylor et al, The classification of amino acid conservation. J. Theor. Biol., 1986; 119;205-218.
Abcam Product Datasheet, Anti-ICOS antibody [C398.4A) ab81459, 2 pages.
Affymetrix eBioscience, Anti-Human CD278 (ICOS) Purified, 1 page.
Boschetti et al., "Therapy with Anti-TNFα Antibody Enhances Number and Function of FOXP3+ Regulatory T Cells in Inflammatory Bowel Diseases," AGA Abstracts, S-743 (2010).
Briskin, Michael J., "Efficacy of Anti-ICOS Agonist Monoclonal Antibodies in Preclinical Models Provides a Rationale for Clinical Development for cancer immunotherapy," Presentation SITC 2015, 22 pages.
Buonfiglio et al., "The T cell activation molecule H4 and the CD28-like molecule ICOS are identical," Eur. J. Immunol., 30:3463-3467 (2000).
Burris III et al., "Phase 1 Safety of ICOS Agonist Antibody JTX-2011 Alone and with Nivolumab (Nivo) in Advanced Solid Tumors; Predicted vs. Observed Pharmacokinetics (PK) in ICONIC" (2017).
Chevalier et al., "Phenotype Alterations in Regulatory T-Cell Subsets in Primary HIV Infection and Identification of Tr1-like Cells at the Main Interleukin 10-Producing CD4+ T Cells," JID, 211: 769-779 (2015).
Deng et al., "An Agonist Human ICOS Monoclonal Antibody that Induces T Cell Activation and Inhibits Proliferation of a Myeloma Cell Line," Hybridoma and Hybridomics, 23(3): 176-182 (2004).
Elpek et al., "Abstract A059: Efficacy of anti-ICOS agonist monoclonal antibodies in preclinical tumor models proves a rationale for clinical development as cancer immunotherapeutics," Cancer Immunology Research, (2016).
Faget et al., "ICOS-Ligand Expression on Plasmacytoid Dendritic Cells Supports Breast Cancer Progression by Promoting the Accumulation of Immunosuppressive CD4+ T Cells," Cancer Res., 72(23): (2012).
Feyler et al., Tumour Cell Generation of Inducible Regulatory T-Cells in Multiple Myeloma is Contact-Dependent and Antigen-Presenting Cell-Independent, PLoS ONE, 7(5): 10 pages (2012).
Harvey et al., "Efficacy of Anti-ICOS Agonist Monoclonal Antibodies in Preclinical Models Provides a Rationale for Clinical Development for cancer immunotherapy," Journal for Immunotherapy of Cancer 3(Suppl 2):O9 (2015).
Hirsch et al., Biomarker Driven Indication Selection in JTX-2011 ICONIC Clinical Trial, poster presented at the American Society of Clinical Oncology (ASCO) Annual Meeting, Jun. 2-6, 2017 in Chicago, Illinois.
Hirsch Heather A., "A biomarker-driven approach for the development of the ICOS agonist antibody, JTX-2011, presentation for the Society for Immunotherapy of Cancer," Nov. 8, 2017 in National Harbor, Maryland, 11 pages.
Janke et al., "Eminent role of ICOS costimulation for T cells interacting with plasmacytoid dendritic cells," Immunology, 11: 353-360 (2006).

(56) References Cited

OTHER PUBLICATIONS

Jounce Therapeutics Press Release, Jounce Therapeutics Initiates Phase 2 Portion of ICONIC Study of JTX-2011 in Patients with Advanced Solid Tumors, Apr. 20, 2017, 3 pages.

Jounce Therapeutics Press Release, Jounce Therapeutics Initiates Phase 1/2 ICONIC Study of JTX-2011 in Patients with Advanced Solid Tumors, Sep. 7, 2016, 2 pages.

Jounce Therapeutics Press Release, Jounce Therapeutics Presents Data Highlighting Advances From Two Programs in its Immuno-Oncology Pipeline at the 2016 AACR Annual Meeting, Apr. 17, 2016, 2 pages.

Jounce Therapeutics Press Release, Jounce Therapeutics Presents Phase 1 Data from ICONIC Study of JTX-2011 in Patients with Advanced Solid Tumors at 2017 ASCO Annual Meeting, Jun. 5, 2017, 6 pages.

Jounce Therapeutics Press Release, Jounce Therapeutics to Present Program Updates at AACR Annual Meeting 2016, Mar. 16, 2016, 2 pages.

Jounce Therapeutics Press Release, Jounce Therapeutics to Present at AACR Annual Meeting on JTX-2011 Cancer Immunotherapy Program, Mar. 22, 2017, 5 pages.

Jounce Therapeutics Press Release, Jounce Therapeutics to Present Phase 1 Data from JTX-2011 ICONIC Trial at 2017 American Society of Clinical Oncology Annual Meeting, May 17, 2017, 5 pages.

Le et al., "Follicular B Lymphomas Generate Regulatory T Cells via the ICOS/ICOSL Pathway and Are Susceptible to Treatment by Anti-ICOS/ICOSL Therapy," Cancer Res., 76(16):4648-4660 (2016).

Löhning et al., "Expression of ICOS in Vivo Defines CD4+ Effector T Cells with High Inflammatory Potential and a Strong Bias for Secretion of Interleukin 10," J. Exp. Med., 197(2): 181-193 (2003).

McAdam et al., "Mouse Inducible Costimulatory Molecule (ICOS) Expression is Enhanced by CD28 Costimulation and Regulates Differentiation of CD4+ T Cells," J. Immunology, 165:5035-5040 (2000).

Michaelson., "Preclinical Assessment of JTX-2011, An Agonist Antibody Targeting ICOS, Supports Evaluation in ICONIC Clinical Trial," Presentation 2017, 27 pages.

Moynihan et al., "Eradication of large established tumors in mice by combination immunotherapy that engages innate and adaptive immune responses," Nature Medicine, 12 pages (2016).

Ohaegbulam et al., "Human cancer immunotherapy with antibodies to the PD-1 and PD-L1 pathway," Trends Mol Med., 21(1): 24-33, 23 pages (2014).

Redoglia et al., "Characterization of H4: a mouse T Lymphocyte activation molecule functionally associated with the DC3/T cell receptor," Eur. J. Immunol., 11: 2781-9 (1996) (abstract only).

Rudikoff et al., "Single Amino Acid Substitution Altering Antigen-Binding Specificity," Proc. Natl. Acad. Sci., 79: 1978-1983 (1982).

Sainson et al., "KY1044, a novel anti-ICOS antibody, elicits long term in vivo anti-tumour efficacy as monotherapy and in combination with immune checkpoint inhibitors", 1 page.

Sanmamed et al., "Agonists of Co-stimulation in Cancer Immunotherapy Directed Against CD137, OX40, GITR, CD27, CD28, and ICOS," Seminars in Oncology, 42(4): 640-655 (2015).

Sears et al., "ICONIC: Phase 1/2 Trial of ICOS Agonist JTX-2011 Alone and in Combination with Nivolumab (nivo)" (2017).

Sharma et al., "Immune Checkpoint Targeting in Cancer Therapy: Toward Combination Strategies with Curative Potential," Cell, 161: 205-214 (2015).

Sharma et al., "The future of immune checkpoint therapy," Science, 348(6230): 56-61 (2015).

Tu et al., "Regulatory T cells, especially ICOS FOXP3+ regulatory T cells, are increased in the hepatocellular carcinoma microenvironment and predict reduced survival," Scientific Reports, 6:35056 (2016).

Ueha et al., "Robust Antitumor Effects of Combined Anti-CD4-Depleting Antibody and Anti-PD-1/PD-L1 Immune Checkpoint Antibody Treatment in Mice," Cancer Immunology Research, 3(6); 631-640 (2015).

\* cited by examiner

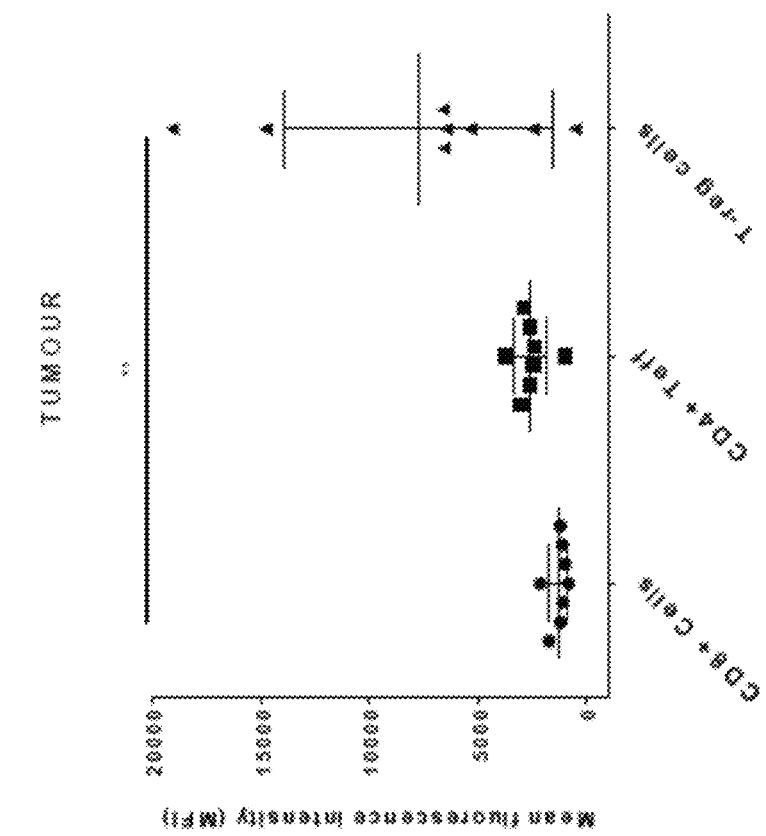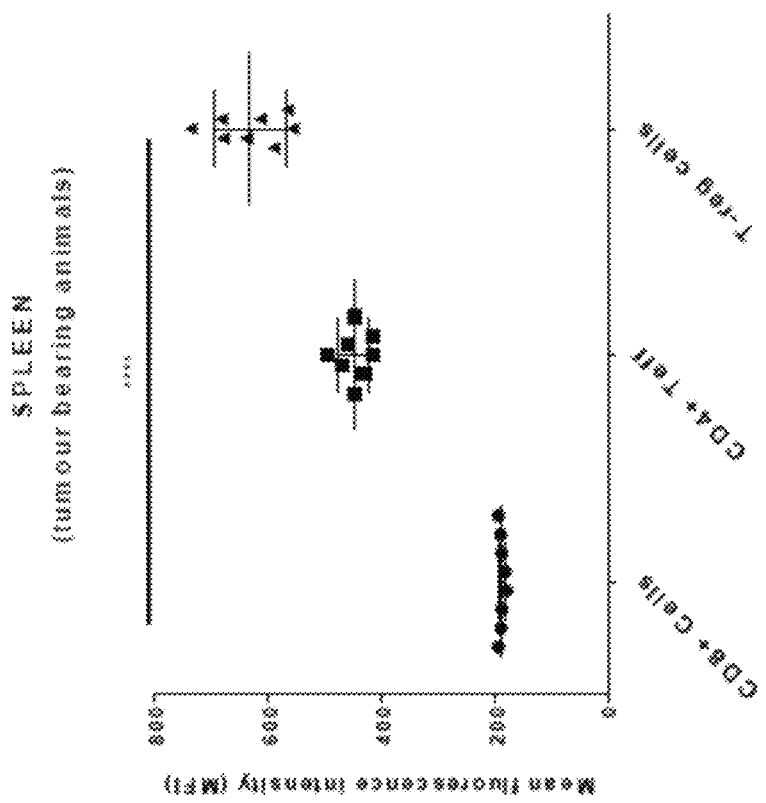
FIG. 21

Heavy chain

```
             ---------FW1---------|--CDR1--|------FW2------|----CDR2----|-----FW3-----
STIM002      QVQLVQSGGEVKKPGASVKVSCKASGYTFTSYGFSWVRQAPGQGLEWMGWISAYRGNTNYAQKLQGRVTM
STIM002-B    ..................................................................
STIM001      ...V....A..........STF.IT...................D.....N....I
CL-64912     ................S.............V....N.A......Q...........CQ.S.
CL-64841     ...........................................................S.
CL-64837     ...........................................................S.
CL-64536     ...........................................................S.
CL-61091     ...M..T.........Y....T.IT...............S.D.D....F....V
germline     ........A........I.................................................
             |-----FW1-----|--CDR1--|-----FW2-----|---CDR2---|----FW3----

-------------------------|------CDR3------|----FW4----
STIM002      TTDTSTSTAYMELRSLRSDDTAVYYCARSTYFYGSGTLYGMDVWGQGTTVTVSS
STIM002-B    ..................................................
STIM001      ............................SGR---YY..............
CL-64913     .A..........................F......SY..A.............
CL-64841     ............................F......SY................
CL-64837     ....................................SY................
CL-64536     ............................F......SY................
CL-61091     ......S.........X...........SGWP---HH.................
germline     ................................---.Y....SY..............
             |-----FW2-----|------CDR3------|----FW4----
```

Light chain

```
             ---------FW1---------|----CDR1----|------FW2------|--CDR2--|---FW3---
STIM002-B    DIVMTQSPLSLPVTPGEPASISCRSSQSLLHSDGYNCLDWYLQKPGQSPQLLIYLGSTRASGFPDRFSGS
STIM002      ..........................Y.........................................
STIM001      ..........................NE.Y..........F....N....V.............
CL-64912     ...........................N.........................................
CL-64841     ...........................N.........................................
CL-64837     ...........................N.........................................
CL-64536     ...........................N.........................................
CL-61091     ...........................N.F.YP........F.V.N....V.............
germline     ...........................N...Y.............................N....V.............
             |-----FW1-----|----CDR1----|-----FW2-----|--CDR2--|---FW3---

--------------------|----CDR3----|----FW4----
STIM002-B    GSGTDFTLKISRVEAEDVGVYYCMQALQTPCSFGQGTKLEIK
STIM002      ..........................L..............
STIM001      .........T........I....S...LT..Q...V......
CL-64913     ..........................................
CL-64841     .....S....................................
CL-64837     ..........................................
CL-64536     ..........................................
CL-61091     ..................I........LT..Q...V......
germline     ..............DDSVS.L......................
             |-----FW3-----|----CDR3----|----FW4----
```

FIG. 35

Heavy chain

```
            ....,....1....,....2....,....3....,....4....,....5....,....6....,....7....
germline    EVQLVESGGGVVRPGGSLRLSCAASGFTFDDYGMSWVRQAPGKGLEWVSGINWNGGSTGYADSVKGRFTI
STIM003     ................................v....v.........................d.d.s..........
CL-71642    .................................................................d.d.s..........
CL-74670    ..............i...........................................i.dn.d.............
            +---------+--------+--------+-------+---------+
                FW1       CDR1      FW2      CDR2       FW3

....,....8....,....9....,...10....,...11....,...12....
germline    SRDNAKNSLYLQMNSLRAEDTALYYCARDYCSGSYYN-YFDYWGQGTLVTVSS
STIM003     .........................f.......hvp........i.......
CL-71642    ..........................a..........vp.............
CL-74670    .........................f...........vp.............
            +---------+--------+--------+
                FW3       CDR3      FW4
```

Light chain

```
            ....,....1....,....2....,....3....,....4....,....5....,....6....,....7....
germline    EIVLTQSPGTLSLSPGERATLSCRASQSVSSSYLAWYQQKPGQAPRLLIYGASSRATGIPDRFSGSGSGT
STIM003     ........................r........r..........................d....
CL-71642    ~....................................................................
CL-74670    ~....................................................................
            +---------+--------+--------+-------+---------+
                FW1       CDR1      FW2      CDR2       FW3

....,....8....,....9....,...10.
germline    DFTLTISRLEPEDFAVYYCQQYGSSPFTFGQGTKVDIK
STIM003     .....s...............h..dm...........
CL-71642    .....................h...a...........
CL-74670    .....................h...a...........
            +---------+--------+--------+
                FW3       CDR3      FW4
```

FIG. 36

Heavy chain

```
              ----------=========-------------========---------------========---=--=======-----
   germline   QITLRESGPTLVKPTQTLTLTCTFSGFSLSTSGVGVGWIRQPPGKALEWLALIYWDDDKRYSPSLKSRLT
   STIM007    .............................t.........................v...............
   STIM008    ........................................................v...............
              +----------------+----------+------+----------+
                     FW1           CDR1      FW2      CDR2      FW3

========--=-----====-------===---=--========--=======-========
   germline   ITKDTSKNQVVLTMTNMDPVDTATYYCARHGSESYYYGMDVWGQGTTVTVSS
   STIM007    ..........................f.t.gy..a...h...........
   STIM008    ..........................f.t.gy..a...h...........
              +--------+----------+--------+
                  FW3      CDR3       FW4
```

Light chain

```
              -----------========---------========---------========---=--=======-----===========
   germline   EIVLTQSPATLSLSPGERATLSCRASQSVSSYLAWYQQKPGQAPRLLIYDASNRATGIPARFSGSGSGTD
   STIM007    ..............................ta....h.............................
   STIM008    ..............................ta....h.............................
              +----------------+----------+--------+----------+
                     FW1           CDR1      FW2      CDR2      FW3

=======--========---=======
   germline   FTLTISSLEPEDFAVYYCQQRSNWPLTFGGGTKVEIK
   STIM007    ....................h................
   STIM008    ....................h................
              +--------+----------+--------+
                  FW3      CDR3       FW4
```

ANTI-ICOS ANTIBODIES

FIELD OF THE INVENTION

This invention relates to compositions for stimulating the mammalian immune response, especially the T cell response. The invention also relates to medical use of such compositions in immuno-oncology, including anti-tumour therapy by promotion of anti-tumour T cell response in a patient, as well as to use of the compositions in other diseases and conditions where it is of therapeutic benefit to modulate the balance between effector T cells and regulatory T cells in favour of effector T cell activity, for example through stimulation of effector T cells and/or through depletion of regulatory T cells.

BACKGROUND

ICOS (Inducible T cell Co-Stimulator) is a member of the CD28 gene family involved in regulating immune responses, in particular humoral immune responses, first identified in 1999 [1]. It is a 55 kDa transmembrane protein, existing as a disulphide linked homodimer with two differentially glycosylated subunits. ICOS is exclusively expressed on T lymphocytes, and is found on a variety of T cell subsets. It is present at low levels on naïve T lymphocytes but its expression is rapidly induced upon immune activation, being upregulated in response to pro-inflammatory stimuli such as on engagement of TCR and co-stimulation with CD28 [2, 3]. ICOS plays a role in the late phase of T cell activation, memory T cell formation and importantly in the regulation of humoral responses through T cell dependent B cell responses [4, 5]. Intracellularly, ICOS binds PI3K and activates the kinases phophoinositide-dependent kinase 1 (PDK1) and protein kinase B (PKB). Activation of ICOS prevents cell death and upregulates cellular metabolism. In the absence of ICOS (ICOS knockout) or in the presence of anti-ICOS neutralising antibodies there would be a suppression of pro-inflammatory responses.

ICOS binds to ICOS ligand (ICOSL) expressed on B-cells and antigen presenting cells (APC) [6, 7]. As a co-stimulatory molecule it serves to regulate TCR mediated immune responses and antibody responses to antigen. The expression of ICOS on T regulatory cells may be important, as it has been suggested that this cell type plays a negative role in immunosurveillance of cancer cells—there is emerging evidence for this in ovarian cancer [8]. Importantly, ICOS expression has been reported to be higher on intratumoural regulatory T cells (TRegs) compared with CD4+ and CD8+ effector cells that are present in the tumour microenvironment. Depletion of TRegs using antibodies with Fc-mediated cellular effector function has demonstrated strong anti-tumour efficacy in a pre-clinical model [9]. Mounting evidence implicates ICOS in an anti-tumour effect in both animal models as well as patients treated with immune-checkpoint inhibitors. In mice deficient in ICOS or ICOSL the anti-tumor effect of anti-CTLA4 therapy is diminished [10] while in normal mice ICOS ligand increases the effectiveness of anti-CTLA4 treatment in melanoma and prostate cancer [11]. Furthermore, in humans a retrospective study of advanced melanoma patients showed increased levels of ICOS following ipilimumab (anti-CTLA4) treatment [12]. In addition, ICOS expression is upregulated in bladder cancer patients treated with anti-CTLA4 [13]. It has also been observed that in cancer patients treated with anti-CTLA4 therapy the bulk of tumour specific IFNγ producing CD4 T-cells are ICOS positive while sustained elevation of ICOS positive CD4 T cells correlates with survival [12, 13, 14].

WO2016/120789 described anti-ICOS antibodies and proposed their use for activating T cells and for treating cancer, infectious disease and/or sepsis. A number of murine anti-ICOS antibodies were generated, of which a sub-set were reported to be agonists of the human ICOS receptor. The antibody "422.2" was selected as the lead anti-ICOS antibody and was humanised to produce a human "IgG4PE" antibody designated "H2L5". H2L5 was reported to have an affinity of 1.34 nM for human ICOS and 0.95 nM for cynomolgus ICOS, to induce cytokine production in T cells, and to upregulate T cell activation markers in conjunction with CD3 stimulation. However, mice bearing implanted human melanoma cells were reported to show only minimal tumour growth delay or increase in survival when treated with H2L5 hIgG4PE, compared with control treated group. The antibody also failed to produce significant further inhibition of tumour growth in combination experiments with ipilimumab (anti-CTLA-4) or pembrolizumab (anti-PD-1), compared with ipilimumab or pembrolizumab monotherapy. Finally, In mice bearing implanted colon cancer cells (CT26), low doses of a mouse cross reactive surrogate of H2L5 in combination with a mouse surrogate of ipilimumab or pembrolizumab only mildly improved overall survival compared with anti-CTL4 and anti-PD1 therapy alone. A similar lack of strong therapeutic benefit was shown in mice bearing implanted EMT6 cells.

WO2016/154177 described further examples of anti-ICOS antibodies. These antibodies were reported to be agonists of CD4+ T cells, including effector CD8+ T cells (TEff), and to deplete T regulator cells (TRegs). Selective effects of the antibodies on TEff vs TReg cells were described, whereby the antibodies could preferentially deplete TRegs while having minimal effect on TEffs that express a lower level of ICOS. The anti-ICOS antibodies were proposed for use in treating cancer, and combination therapy with anti-PD-1 or anti-PD-L1 antibodies was described.

SUMMARY OF THE INVENTION

An antibody to ICOS that acts to increase effector T cell activity represents a therapeutic approach in immunooncology and in other medical contexts where a CD8+ T cell response is beneficial, including various diseases and conditions and in vaccination regimens. In many diseases and conditions involving an immune component, a balance exists between effector T cells (TEff) which exert the CD8+ T cell immune response, and regulatory T cells (TReg) which suppress that immune response by downregulating TEffs. The present invention relates to antibodies that modulate this TEff/TReg balance in favour of effector T cell activity. Antibodies that trigger the depletion of ICOS highly positive regulatory T cells would relieve the suppression of TEffs, and thus have a net effect of promoting the effector T cell response. An additional or complementary mechanism for an anti-ICOS antibody is via agonistic activity at the ICOS receptor level, to stimulate the effector T cell response.

The relative expression of ICOS on effector T cells (TEff) compared with regulatory T cells (TReg), and the relative activities of these cell populations, will influence the overall effect of an anti-ICOS antibody in vivo. An envisaged mode of action combines agonism of effector T cells with depletion of ICOS positive regulatory T cells. Differential and even opposing effects on these two different T cell populations may be achievable due to their different levels of ICOS expression. Dual-engineering of the variable and constant regions respectively of an anti-ICOS antibody can provide a molecule that exerts a net positive effect on effector T cell response by affecting the CD8/TReg ratio. An antigen-binding domain of an agonist antibody, which activates the ICOS receptor, may be combined with an antibody constant (Fc) region that promotes downregulation and/or clearance of highly expressing cells to which the antibody is bound. An effector positive constant region may be used to recruit cellular effector functions against the target cells (TRegs), e.g., to promote antibody-dependent cell-mediated cytotoxicity (ADCC) or antibody dependent cell phagocytosis (ADCP). The antibody may thus act both to promote effector T cell activation and to downregulate immunosuppressive T Regulatory cells. Since ICOS is more highly expressed on TRegs than on TEffs, a therapeutic balance may be achieved whereby Teff function is promoted while TRegs are depleted, resulting in a net increase in the T cell immune response (e.g, anti-tumour response or other therapeutically beneficial T cell response).

Several pre-clinical and clinical studies have shown a strong positive correlation between high effector T-cell to T-reg cell ratio in the tumour microenvironment (TME) and overall survival. In ovarian cancer patients the ratio of CD8:T-reg cells has been reported to be an indicator of good clinical outcome [15]. A similar observation was made in metastatic melanoma patients after receiving ipilumumab [16]. In pre-clinical studies, it has also been shown that high effector cell:T-reg ratio in TME is associated with anti-tumour response [43].

This invention provides antibodies that bind human ICOS. The antibodies target the ICOS extracellular domain and thereby bind to T cells expressing ICOS. Examples are provided of antibodies that have been designed to have an agonistic effect on ICOS, thus enhancing the function of effector T cells, as indicated by an ability to increase IFNγ expression and secretion. As noted, anti-ICOS antibodies may also be engineered to deplete cells to which they bind, which should have the effect of preferentially downregulating regulatory T cells, lifting the suppressive effect of these cells on the effector T cell response and thus promoting the effector T cell response overall. Regardless of their mechanism of action, it is demonstrated empirically that anti-ICOS antibodies according to the present invention do stimulate T cell response and have anti-tumour effects in vivo, as shown in the Examples. Through selection of appropriate antibody formats such as those including constant regions with a desired level of Fc effector function, or absence of such effector function where appropriate, the anti-ICOS antibodies may be tailored for use in a variety of medical contexts including treatment of diseases and conditions in which an effector T cell response is beneficial and/or where suppression of regulatory T cells is desired.

Exemplary antibodies include STIM001, STIM002, STIM002-B, STIM003, STIM004, STIM005, STIM006, STIM007, STIM008 and STIM009, the sequences of which are set out herein.

An antibody according to the invention may be one that competes for binding to human ICOS with an antibody (e.g., human IgG1, or an scFv) comprising the heavy and light chain complementarity determining regions (CDRs) of STIM001, STIM002, STIM002-B, STIM003, STIM004, STIM005, STIM006, STIM007, STIM008 or STIM009, optionally an antibody comprising the VH and VL domains of STIM001, STIM002, STIM002-B, STIM003, STIM004, STIM005, STIM006, STIM007, STIM008 or STIM009.

An antibody according to the present invention may comprise one or more CDRs of any of STIM001, STIM002, STIM002-B, STIM003, STIM004, STIM005, STIM006, STIM007, STIM008 and STIM009 (e.g., all 6 CDRs of any such antibody, or a set of HCDRs and/or LCDRs) or variants thereof as described herein.

The antibody may comprise an antibody VH domain comprising CDRs HCDR1, HCDR2 and HCDR3 and an antibody VL domain comprising CDRs LCDR1, LCDR2 and LCDR3, wherein the HCDR3 is an HCDR3 of an antibody selected from STIM001, STIM002, STIM002-B, STIM003, STIM004, STIM005, STIM006, STIM007, STIM008 and STIM009 or comprises that HCDR3 with 1, 2, 3, 4 or 5 amino acid alterations. The HCDR2 may be the HCDR2 of the selected antibody or it may comprise that HCDR2 with 1, 2, 3, 4 or 5 amino acid alterations. The HCDR1 may be the HCDR1 of the selected antibody or it may comprise that HCDR1 with 1, 2, 3, 4 or 5 amino acid alterations.

The antibody may comprise an antibody VL domain comprising CDRs HCDR1, HCDR2 and HCDR3 and an antibody VL domain comprising CDRs LCDR1, LCDR2 and LCDR3, wherein the LCDR3 is an LCDR3 of an antibody selected from STIM001, STIM002, STIM002-B, STIM003, STIM004, STIM005, STIM006, STIM007, STIM008 and STIM009 or comprises that LCDR3 with 1, 2, 3, 4 or 5 amino acid alterations. The LCDR2 may be the LCDR2 of the selected antibody or it may comprise that LCDR2 with 1, 2, 3, 4 or 5 amino acid alterations. The LCDR1 may be the LCDR1 of the selected antibody or it may comprise that LCDR1 with 1, 2, 3, 4 or 5 amino acid alterations.

An antibody may comprise:

an antibody VH domain comprising complementarity determining regions HCDR1, HCDR2 and HCDR3, and an antibody VL domain comprising complementarity determining regions LCDR1, LCDR2 and LCDR3, wherein the heavy chain complementarity determining regions are those of STIM001, STIM002, STIM002-B, STIM003, STIM004, STIM005, STIM006, STIM007, STIM008 or STIM009 or comprise the STIM001, STIM002, STIM002-B, STIM003, STIM004 or STIM005, STIM006, STIM007, STIM008 or STIM009 heavy chain complementarity determining regions with 1, 2, 3, 4 or 5 amino acid alterations; and/or wherein the light chain complementarity determining regions are those of antibody STIM001, STIM002, STIM002-B, STIM003, STIM004, STIM005, STIM006, STIM007, STIM008 or STIM009, or comprise the STIM001, STIM002, STIM002-B, STIM003, STIM004, STIM005, STIM006, STIM007, STIM008 or STIM009 light chain complementarity determining regions with 1, 2, 3, 4 or 5 amino acid alterations.

An antibody may comprise a VH domain comprising a set of heavy chain complementarity determining regions (HCDRs) HCDR1, HCDR2 and HCDR3, wherein HCDR1 is the HCDR1 of STIM003,
HCDR2 is the HCDR2 of STIM003,
HCDR3 is the HCDR3 of STIM003,
or comprising that set of HCDRs with 1, 2, 3, 4, 5 or 6 amino acid alterations.

An antibody may comprise a VL domain comprising a set of light chain complementarity determining regions (LCDRs) LCDR1, LCDR2 and LCDR3, wherein LCDR1 is the LCDR1 of STIM003,
LCDR2 is the LCDR2 of STIM003,
LCDR3 is the LCDR3 of STIM003,
or comprising that set of LCDRs with 1, 2, 3 or 4 amino acid alterations.

Amino acid alterations (e.g., substitutions) may be at any residue position in the CDRs. Examples of amino acid alterations are those illustrated in FIG. 35, FIG. 36 and FIG. 37, which show alignments of variant sequences of anti-ICOS antibodies. Thus, an amino acid alteration in a STIM003 CDR may be a substitution of the residue present at the corresponding position in antibody CL-74570 or antibody CL-71642 as indicated in FIG. 36.

Example amino acid alterations in STIM003 CDRs are substitutions at the following residue positions, defined according to IMGT:

In HCDR1, substitution at IMGT position 28, optionally a conservative substitution, e.g., V28F.
In HCDR2, substitution at IMGT position 59, 63 and/or 64. Optionally the substitution at position 59 is N59I, the substitution at position 63 is G63D and/or the substitution at position 64 is D64N and/or D64S.
In HCDR3, substitution at IMGT position 106, 108, 109 and/or 112. Optionally the substitution at position 106 is R106A, the substitution at position 108 is F108Y, the substitution at position 109 is Y109F and/or the substitution at position 112 is H112N.
In LCDR1, substitution at position 36, e.g., R36S.
In LCDR3, substitution at position 105, 108 and/or 109. Optionally the substitution at position 105 is H105Q, the substitution at position 108 is D108G and/or the substitution at position 109 is M109N or M109S.

Antibodies of the invention may comprise VH and/or VL domain framework regions corresponding to human germline gene segment sequences. For example, it may comprise one or more framework regions of STIM001, STIM002, STIM002-B, STIM003, STIM004, STIM005, STIM006, STIM007, STIM008 or STIM009. The framework region or framework regions may be a FR1, FR2, FR3 and/or FR4.

As described in Example 12, Table E12-1 shows the human germline V, D and J gene segments that generated the VH domains of these antibodies through recombination and Table E12-2 shows the human germline V and J gene segments that generated the VL domains of these antibodies through recombination. Antibody VH and VL domains of the present invention may be based on these V(D)J segments.

An antibody of the invention may comprise an antibody VH domain which
(i) is derived from recombination of a human heavy chain V gene segment, a human heavy chain D gene segment and a human heavy chain J gene segment, wherein
the V segment is IGHV1-18 (e.g., V1-18*01), IGVH3-20 (e.g. V3-20*d01), IGVH3-11 (e.g, V3-11*01) or IGVH2-5 (e.g., V2-5*10);
the D gene segment is IGHD6-19 (e.g., IGHD6-19*01), IGHD3-10 (e.g., IGHD3-10*01) or IGHD3-9 (e.g., IGHD3-9*01); and/or
the J gene segment is IGHJ6 (e.g., IGHJ6*02), IGHJ4 (e.g., IGHJ4*02) or IGHJ3 (e.g., IGHJ3*02), or
(ii) comprises framework regions FR1, FR2, FR3 and FR4, wherein
FR1 aligns with human germline V gene segment IGHV1-18 (e.g., V1-18*01), IGVH3-20 (e.g. V3-20*d01), IGVH3-11 (e.g, V3-11*01) or IGVH2-5 (e.g., V2-5*10), optionally with 1, 2, 3, 4 or 5 amino acid alterations,
FR2 aligns with human germline V gene segment IGHV1-18 (e.g., V1-18*01), IGVH3-20 (e.g. V3-20*d01), IGVH3-11 (e.g, V3-11*01) or IGVH2-5 (e.g., V2-5*10), optionally with 1, 2, 3, 4 or 5 amino acid alterations,
FR3 aligns with human germline V gene segment IGHV1-18 (e.g., V1-18*01), IGVH3-20 (e.g. V3-20*d01), IGVH3-11 (e.g, V3-11*01) or IGVH2-5 (e.g., V2-510), optionally with 1, 2, 3, 4 or 5 amino acid alterations, and/or
FR4 aligns with human germline J gene segment IGJH6 (e.g., JH6*02), IGJH4 (e.g., JH4*02) or IGJH3 (e.g., JH3*02), optionally with 1, 2, 3, 4 or 5 amino acid alterations.

FR1, FR2 and FR3 of the VH domain typically align with the same germline V gene segment. Thus, for example, the antibody may comprise a VH domain derived from recombination of human heavy chain V gene segment IGHV3-20 (e.g., VH3-20*d01), a human heavy chain D gene segment and a human heavy chain J gene segment IGJH4 (e.g., JH4*02). An antibody may comprise VH domain framework regions FR1, FR2, FR3 and FR4, wherein FR1, FR2 and FR3 each align with human germline V gene segment IGHV3-20 (e.g., IGVH3-20*d01) with up to 1, 2, 3, 4 or 5 amino acid alterations, and a FR4 that aligns with human germline J gene segment IGHJ4 (e.g., IGHJ4*02) with up to 1, 2, 3, 4 or 5 amino acid alterations. Alignment may be exact, but in some cases one or more residues can be mutated from germline, so there may be amino acid substitutions present, or in rarer cases deletions or insertions.

An antibody of the invention may comprise an antibody VL domain which
(i) is derived from recombination of a human light chain V gene segment and a human light chain J gene segment, wherein
the V segment is IGKV2-28 (e.g., IGKV2-28*01), IGKV3-20 (e.g., IGKV3-20*01), IGKV1D-39 (e.g., IGKV1D-39*01) or IGKV3-11 (e.g., IGKV3-11*01), and/or
the J gene segment is IGKJ4 (e.g., IGKJ4*01), IGKJ2 (e.g., IGKJ2*04), IGLJ3 (e.g., IGKJ3*01) or IGKJ1 (e.g., IGKJ1*01); or
(ii) comprises framework regions FR1, FR2, FR3 and FR4, wherein
FR1 aligns with human germline V gene segment IGKV2-28 (e.g., IGKV2-28*01), IGKV3-20 (e.g., IGKV3-20*01), IGKV1D-39 (e.g., IGKV1D-39*01) or IGKV3-11 (e.g., IGKV3-11*01), optionally with 1, 2, 3, 4 or 5 amino acid alterations,
FR2 aligns with human germline V gene segment IGKV2-28 (e.g., IGKV2-28*01), IGKV3-20 (e.g., IGKV3-20*01), IGKV1D-39 (e.g., IGKV1D-39*01) or IGKV3-11 (e.g., IGKV3-11*01), optionally with 1, 2, 3, 4 or 5 amino acid alterations,
FR3 aligns with human germline V gene segment IGKV2-28 (e.g., IGKV2-28*01), IGKV3-20 (e.g., IGKV3-20*01), IGKV1D-39 (e.g., IGKV1D-39*01) or IGKV3-11 (e.g., IGKV3-11*01), optionally with 1, 2, 3, 4 or 5 amino acid alterations, and/or
FR4 aligns with human germline J gene segment IGKJ4 (e.g., IGKJ4*01), IGKJ2 (e.g., IGKJ2*04), IGKJ3 (e.g., IGKJ3*01) or IGKJ1 (e.g., IGKJ1*01), optionally with 1, 2, 3, 4 or 5 amino acid alterations.

FR1, FR2 and FR3 of the VL domain typically align with the same germline V gene segment. Thus, for example, the antibody may comprise a VL domain derived from recombination of human light chain V gene segment IGKV3-20 (e.g., IGKV3-20*01) and human light chain J gene segment IGKJ3 (e.g., IGKJ3*01). An antibody may comprise VL domain framework regions FR1, FR2, FR3 and FR4, wherein FR1, FR2 and FR3 each align with human germline V gene segment IGKV3-20 (e.g., IGKV3-20*01) with up to 1, 2, 3, 4 or 5 amino acid alterations, and a FR4 that aligns with human germline J gene segment IGKJ3 (e.g., IGKJ3*01) with up to 1, 2, 3, 4 or 5 amino acid alterations. Alignment may be exact, but in some cases one or more residues can be mutated from germline, so there may be amino acid substitutions present, or in rarer cases deletions or insertions.

An antibody according to the invention may comprise an antibody VH domain which is the VH domain of STIM001, STIM002, STIM002-B, STIM003, STIM004 or STIM005, STIM006, STIM007, STIM008 or STIM009, or which has an amino acid sequence at least 90% identical to the antibody VH domain sequence of STIM001, STIM002, STIM002-B, STIM003, STIM004, STIM005, STIM006, STIM007, STIM008 or STIM009. The amino acid sequence identity may be at least 95%.

The antibody may comprise an antibody VL domain which is the VL domain of STIM001, STIM002, STIM002-B, STIM003, STIM004 or STIM005, STIM006, STIM007, STIM008 or STIM009, or which has an amino acid sequence at least 90% identical to the antibody VL domain sequence of STIM001, STIM002, STIM002-B, STIM003, STIM004, STIM005, STIM006, STIM007, STIM008 or STIM009. The amino acid sequence identity may be at least 95%.

An antibody VH domain having the HCDRs of STIM001, STIM002, STIM002-B, STIM003, STIM004, STIM005, STIM006, STIM007, STIM008 or STIM009, or having a variant of those CDRs, may be paired with an antibody VL domain having the LCDRs of the same antibody, or having a variant of those CDRs. Similarly, the VH domain of any of STIM001, STIM002, STIM002-B, STIM003, STIM004, STIM005, STIM006, STIM007, STIM008 or STIM009, or a variant of that VH domain, may be paired with a VL domain of the same antibody, or a VL domain variant of the same antibody.

For instance, the antibody may comprise the antibody STIM001 VH domain and the STIM001 VL domain. In another example, the antibody may comprise the antibody STIM002 VH domain and the STIM002 VL domain. In another example, the antibody may comprise the antibody STIM003 VH domain and the STIM003 VL domain.

Antibodies may include constant regions, optionally human heavy and/or light chain constant regions. An exemplary isotype is IgG, e.g., human IgG1.

Further aspects of the invention include nucleic acid molecules encoding sequences of the antibodies described herein, host cells containing such nucleic acids, and methods of producing the antibodies by culturing the host cells and expressing and optionally isolating or purifying the antibodies. The expressed antibody is thereby obtained. VH and VL domains of antibodies described herein may similarly be produced and are aspects of the present invention. Pharmaceutical compositions comprising the antibodies are also provided.

Other aspects of the invention relate to ICOS knock out non-human animals and their use for generating antibodies to human ICOS. In an ICOS knock out animal, ICOS is not expressed, for example because the gene encoding ICOS has been inactivated or deleted from the animal's genome. Such animals are useful for generating species cross-reactive antibodies, which recognise both human ICOS and ICOS from the non-human species. The normal process of immune tolerance means that lymphocytes that recognise "self" antigens are deleted or inactivated to prevent autoimmune reactions in the body, whereas the absence of the endogenous ICOS antigen in the non-human knock out animal means that the animal's immune system should not be tolerised to that antigen and therefore can mount an immune response against ICOS when injected as recombinant protein or using cell lines or vesicles expressing ICOS. The immune repertoire of the knock out animal should contain lymphocytes able to recognise the ICOS protein from that animal species. A non-human test animal (e.g., a mouse) immunised with human ICOS may thus generate antibodies that bind both human ICOS and the test animal ICOS (e.g., mouse ICOS).

This has at least two advantages. First, a species cross-reactive antibody can be used for pre-clinical testing in the non-human test animal before being taken forward into development in human clinical trials. Second, a knock out animal's immune system may be able to recognise a greater number of possible epitopes on a human ICOS molecule compared with those recognised by an ICOS-expressing animal, so that the immune repertoire of the knock out animal may contain a greater functional diversity of antibodies. Since there is similarity between the sequences of homologous ICOS molecules from different species, the immune system of a non-human animal may ordinarily be tolerised to those regions of the human ICOS protein that match those of the non-human animal ICOS, whereas this tolerisation does not occur in a knock out animal.

The ability to use an ICOS knock out animal, and its advantage for generating cross-reactive antibodies, is shown in the Examples. It is particularly surprising that an ICOS knock out animal could be successfully immunised to produce an antibody response, because ICOS itself is involved in the immune system biology such as formation and maintenance of the germinal centers and contributes to the generation of an immune response through its role on T follicular helper cells which are ICOS+ve cells [37]. With this in mind, an ICOS knock out animal might be predicted to generate a poor antibody response at best. Surprisingly, strong titres were obtained in ICOS knock out mice, and highly functional antibodies were isolated from among the antibody repertoire, including desirable cross-reactive antibodies.

Exemplary embodiments of the invention are set out in the appended claims.

BRIEF DESCRIPTION OF THE DRAWINGS

Certain aspects and embodiments of the invention will now be described in more detail with reference to the accompanying drawings.

(FIG. 11A) Isotype control; (FIG. 11B) Anti-PDL1 mIgG2a AbW; (FIG. 11C) Anti ICOS STIM003 mIgG1; (FIG. 11D) Anti ICOS STIM003 mIgG2a; (FIG. 11E) Anti-PDL1 mIgG2a AbW+STIM003 mIgG1; (FIG. 11F) Anti-PDL1 mIgG2a AbW+STIM003 mIgG2a. STIM003 mIgG2 significantly inhibits CT26 tumour growth when combined with anti-PDL1 (AbW) mIgG2a.

FIG. 15A, percentage of CD3 cells that are positive for CD4 cells. FIG. 15B, percentage of CD3 cells that are positive for CD8 cells. FIG. 15C, percentage of CD4 cells that are Foxp3+ & CD25+. FIG. 15D, percentage of CD4 cells in spleen that are positive for Foxp3+ & CD25+. FIG. 15E, percentage of CD4 effector cells in total CD4 cells. FIG. 15F, ratio of CD8 effector to T-Reg cells. FIG. 15G, ratio of CD4 effector to T-Reg cells. Statistical analysis were performed using GraphPad Prism, all the Antibody treated groups were compared with saline treated group, P values were noted when significant (p<0.05). Values denote means+SD (n=8 mice/group). For F: Values denote mean+SEM.

FIG. 21: Relative expression of ICOS on the surface of immune cells—CD8 T effector, CD4 T effector and CD4/FoxP3 TRegs—as determined by the mean fluorescence intensity (MFI). Values denote mean±SD (n=8). P values were calculated using nonparametric Dunn's multiple comparisons test. **=p<0.0001, =p<0.01. Note the difference in the fluorescence intensity between spleen (low) and tumours (high).

FIG. 35: STIM002 VH (top) and VL (bottom) domain amino acid sequences, showing residues that differ in the corresponding sequences of STIM001, STIM002B and related antibodies CL-61091, CL-64536, CL-64837, CL-64841 and CL-64912 and/or in the human germline. Sequence numbering is according to IMGT.

FIG. 36: STIM003 VH (top) and VL (bottom) domain amino acid sequences, showing residues that differ in the corresponding sequences of related antibodies CL-71642 and CL-74570 and/or in the human germline. Sequence numbering is according to IMGT. The VL domain of antibody CL-71642 obtained from sequencing is shown here without the N terminal residue. From the alignment it can be seen that the full VH domain sequence would comprise an N terminal glutamic acid.

FIG. 37: STIM007 VH (top) and VL (bottom) domain amino acid sequences, showing residues that differ in the corresponding sequences of STIM008 and/or in the human germline. Sequence numbering is according to IMGT.

(FIG. 39A): The % of immune cell subtypes that are positive for ICOS expression and (FIG. 39B): the ICOS dMFI (relative ICOS expression on ICOS positive cell) of immune cell subtypes of animals treated with saline or anti-PD-L1 or anti-PD-1 surrogate antibodies. The mice were implanted with 100 μl of 1×10☐ viable cells/ml on day 0 (n=7 or n=8). The animals were dosed i.p with 130 ug of antibody on day 13 and day 15. The tissue samples were isolated and analysed on day 16. CD4+/FOXP3+ cells were only included for the TReg population (right end side graphs) and were excluded from the "effector" CD4 cells (left end side graphs) which are all Foxp3 negative. See Example 22.

(FIG. 40A): Saline; (FIG. 40B): STIM003 mIgG2a multiple dose; (FIG. 40C): STIM003 mIgG2a single dose. See Example 23.

FIG. 42A, FIG. 42B, FIG. 42C, and FIG. 42D show the percentage of ICOS positive cells at all the time points in four different tissues. FIG. 42E, FIG. 42F, FIG. 42G, and FIG. 42H show the ICOS dMFI (relative expression) all the time points in all the four different tissues. See Example 24.

(FIG. 44A) & (FIG. 44B), CD8:T-reg ratio in tumour and blood, (FIG. 44C) & (FIG. 44D) CD4-eff:T-reg ratio in tumour and blood. See Example 24.

DETAILED DESCRIPTION

ICOS

Figure 1A:
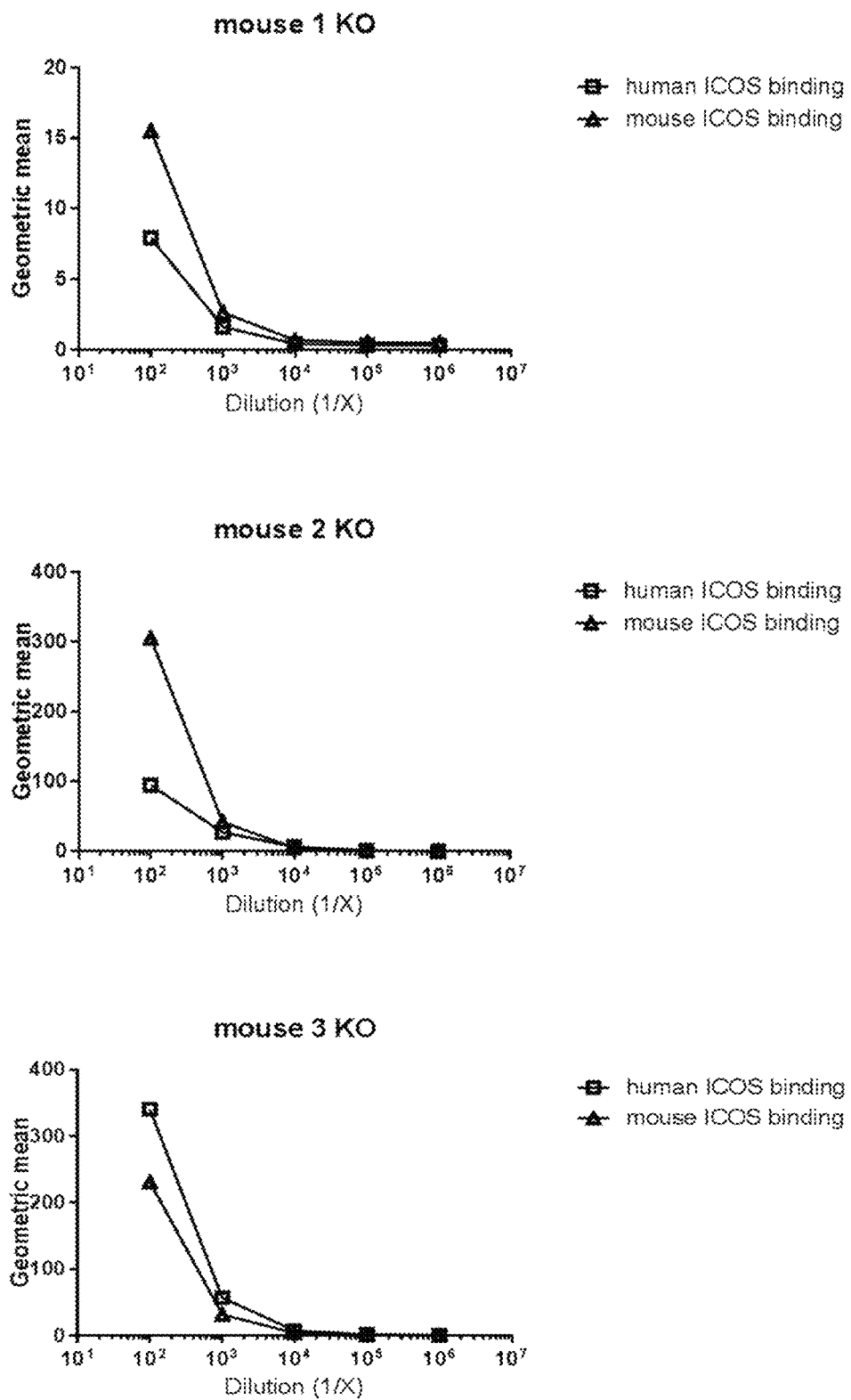
FIG. 1A and FIG. 1B: Determination of serum titres of ICOS KO and wild type Kymouse against both human and mouse ICOS expressed on CHO cells by flow cytometry. Data illustrate ability of immunoglobulin in sera of (a) ICOS KO mice (KO) or (b) wild type non-ICOS KO mice (HK or HL), each immunised with human ICOS expressing MEF cells and human ICOS protein, to bind human ICOS (human ICOS binding) or mouse ICOS (mouse ICOS binding) expressed on CHO cells. Geometric mean is a measure of fluorescent intensity of immunoglobulin binding to cells as determined by flow cytometry.

Antibodies according to the present invention bind the extracellular domain of human ICOS. Thus, the antibodies bind ICOS-expressing T lymphocytes. "ICOS" or "the ICOS receptor" referred to herein may be human ICOS, unless the context dictates otherwise. Sequences of human, cynomolgus and mouse ICOS are shown in the appended sequence listing, and are available from NCBI as human NCBI ID: NP_036224.1, mouse NCBI ID: NP_059508.2 and cynomolgus GenBank ID: EHH55098.1.

Cross-Reactivity

Antibodies according to the present invention are preferably cross-reactive, and may for example bind the extracellular domain of mouse ICOS as well as human ICOS. The antibodies may bind other non-human ICOS, including ICOS of primates such as cynomolgus. An anti-ICOS antibody intended for therapeutic use in humans must bind human ICOS, whereas binding to ICOS of other species would not have direct therapeutic relevance in the human clinical context. Nevertheless, the data herein indicate that antibodies that bind both human and mouse ICOS have properties that render them particularly suitable as agonist and depleting molecules. This may result from one or more particular epitopes being targeted by the cross-reactive antibodies. Regardless of the underlying theory, however, cross-reactive antibodies are of high value and are excellent candidates as therapeutic molecules for pre-clinical and clinical studies.

As explained in the experimental Examples, the STIM antibodies described here were generated using Kymouse™ technology where the mouse had been engineered to lack expression of mouse ICOS (an ICOS knock-out). ICOS knock-out transgenic animals and their use for generating cross-reactive antibodies are further aspects of the present invention.

One way to quantify the extent of species cross-reactivity of an antibody is as the fold-difference in its affinity for antigen or one species compared with antigen of another species, e.g., fold difference in affinity for human ICOS vs mouse ICOS. Affinity may be quantified as $K_D$, referring to the equilibrium dissociation constant of the antibody-antigen reaction as determined by SPR with the antibody in Fab format as described elsewhere herein. A species cross-reactive anti-ICOS antibody may have a fold-difference in affinity for binding human and mouse ICOS that is 30-fold or less, 25-fold or less, 20-fold or less, 15-fold or less, 10-fold or less or 5-fold or less. To put it another way, the $K_D$ of binding the extracellular domain of human ICOS may be within 30-fold, 25-fold, 20-fold, 15-fold, 10-fold or 5-fold of the $K_D$ of binding the extracellular domain of mouse ICOS. Antibodies can also be considered cross-reactive if the $K_D$ for binding antigen of both species meets a threshold value, e.g., if the $K_D$ of binding human ICOS and the $K_D$ of binding mouse ICOS are both 10 mM or less, preferably 5 mM or less, more preferably 1 mM or less. The $K_D$ may be 10 nM or less, 5 nM or less, 2 nM or less, or 1 nM or less. The $K_D$ may be 0.9 nM or less, 0.8 nM or less, 0.7 nM or less, 0.6 nM or less, 0.5 nM or less, 0.4 nM or less, 0.3 nM or less, 0.2 nM or less, or 0.1 nM or less.

An alternative measure of cross-reactivity for binding human ICOS and mouse ICOS is the ability of an antibody to neutralise ICOS ligand binding to ICOS receptor, such as in an HTRF assay (see Example 8). Examples of species cross-reactive antibodies are provided herein, including STIM001, STIM002, STIM002-B, STIM003, STIM005 and STIM006, each of which was confirmed as neutralising binding of human B7-H2 (ICOS ligand) to human ICOS and neutralising binding of mouse B7-H2 to mouse ICOS in an HTRF assay. Any of these antibodies or their variants may be selected when an antibody cross-reactive for human and mouse ICOS is desired. A species cross-reactive anti-ICOS antibody may have an IC50 for inhibiting binding of human ICOS to human ICOS receptor that is within 25-fold, 20-fold, 15-fold, 10-fold or 5-fold of the IC50 for inhibiting mouse ICOS to mouse ICOS receptor as determined in an HTRF assay. Antibodies can also be considered cross-reactive if the IC50 for inhibiting binding of human ICOS to human ICOS receptor and the IC50 for inhibiting binding of mouse ICOS to mouse ICOS receptor are both 1 mM or less, preferably 0.5 mM or less, e.g., 30 nM or less, 20 nM or less, 10 nM or less. The IC50s may be 5 nM or less, 4 nM or less, 3 nM or less or 2 nM or less. In some cases the IC50s will be at least 0.1 nM, at least 0.5 nM or at least 1 nM.

Specificity

Antibodies according to the present invention are preferably specific for ICOS. That is, the antibody binds its epitope on the target protein, ICOS (human ICOS, and preferably mouse and/or cynomolgus ICOS as noted above), but does not show significant binding to molecules that do not present that epitope, including other molecules in the CD28 gene family. An antibody according to the present invention preferably does not bind human CD28. The antibody preferably also does not bind mouse or cynomolgus CD28.

CD28 co-stimulates T cell responses when engaged by its ligands CD80 and CD86 on professional antigen presenting cells in the context of antigen recognition via the TCR. For various in vivo uses of the antibodies described herein, the avoidance of binding to CD28 is considered advantageous. Non-binding of the anti-ICOS antibody to CD28 should allow CD28 to interact with its native ligands and to generate appropriate co-stimulatory signal for T cell activation. Additionally, non-binding of the anti-ICOS antibody to CD28 avoids the risk of superagonism. Over-stimulation of CD28 can induce proliferation in resting T cells without the normal requirement for recognition of a cognate antigen via the TCR, potentially leading to runaway activation of T cells and consequent cytokine-release syndrome, especially in human subjects. The non-recognition of CD28 by antibodies according to the present invention therefore represents an advantage in terms of their safe clinical use in humans.

As discussed elsewhere herein, the present invention extends to multispecific antibodies (e.g., bispecifics). A multispecific (e.g., bispecific) antibody may comprise (i) an antibody antigen binding site for ICOS and (ii) a further antigen binding site (optionally an antibody antigen binding site, as described herein) which recognises another antigen (e.g., PD-L1). Specific binding of individual antigen binding sites may be determined. Thus, antibodies that specifically bind ICOS include antibodies comprising an antigen binding site that specifically binds ICOS, wherein optionally the antigen binding site for ICOS is comprised within an antigen-binding molecule that further includes one or more additional binding sites for one or more other antigens, e.g., a bispecific antibody that binds ICOS and PD-L1.

Affinity

The affinity of binding of an antibody to ICOS may be determined. Affinity of an antibody for its antigen may be quantified in terms of the equilibrium dissociation constant $K_D$, the ratio Ka/Kd of the association or on-rate (Ka) and the dissociation or off-rate (kd) of the antibody-antigen interaction. Kd, Ka and Kd for antibody-antigen binding can be measured using surface plasmon resonance (SPR).

An antibody according to the present invention may bind the EC domain of human ICOS with a $K_D$ of 10 mM or less, preferably 5 mM or less, more preferably 1 mM or less. The $K_D$ may be 50 nM or less, 10 nM or less, 5 nM or less, 2 nM or less, or 1 nM or less. The $K_D$ may be 0.9 nM or less, 0.8 nM or less, 0.7 nM or less, 0.6 nM or less, 0.5 nM or less, 0.4 nM or less, 0.3 nM or less, 0.2 nM or less, or 0.1 nM or less. The $K_D$ may be at least 0.001 nM, for example at least 0.01 nM or at least 0.1 nM.

Quantification of affinity may be performed using SPR with the antibody in Fab format. A suitable protocol is as follows:

1. Coupling anti-human (or other antibody constant region species-matched) IgG to a biosensor chip (e.g., GLM chip) such as by primary amine coupling;
2. Exposing the anti-human IgG (or other matched species antibody) to a test antibody, e.g., in Fab format, to capture test antibody on the chip;
3. Passing the test antigen over the chip's capture surface at a range of concentrations, e.g., at 5000 nM, 1000 nM, 200 nM, 40 nM, 8 nM and 2 nM, and at 0 nM (i.e., buffer alone); and
4. Determining the affinity of binding of test antibody to test antigen using SPR at 25° C. Buffer may be at pH 7.6, 150 mM NaCl, 0.05% detergent (e.g., P20) and 3 mM EDTA. Buffer may optionally contain 10 mM HEPES. HBS-EP can be used as running buffer. HBS-EP is available from Teknova Inc (California; catalogue number H8022).

Regeneration of the capture surface can be carried out with 10 mM glycine at pH 1.7. This removes the captured antibody and allows the surface to be used for another interaction. The binding data can be fitted to 1:1 model inherent using standard techniques, e.g., using a model inherent to the ProteOn XPR36™ analysis software.

A variety of SPR instruments are known, such as Biacore™, ProteOn XPR36™ (Bio-Rad®), and KinExA® (Sapidyne Instruments, Inc). Worked examples of SPR are found in Example 7.

As described, affinity may be determined by SPR with the antibody in Fab format, with the antigen coupled to the chip surface and the test antibody passed over the chip in Fab format in solution, to determine affinity of the monomeric antibody-antigen interaction. Affinity can be determined at any desired pH, e.g., pH 5.5 or pH 7.6, and any desired temperature e.g., 25° C. or 37° C. As reported in Example 7, antibodies according to the present invention bound human ICOS with an apparent affinity of less than 2 nM, as determined by SPR using the antibody in monovalent (Fab) format.

Other ways to measure binding of an antibody to ICOS include fluorescence activated cell sorting (FACS), e.g., using cells (e.g., CHO cells) with exogenous surface expression of ICOS or activated primary T cells expressing endogenous levels of ICOS. Antibody binding to ICOS-expressing cells as measured by FACS indicates that the antibody is able to bind the extracellular (EC) domain of ICOS.

ICOS Receptor Agonism

The ICOS ligand (ICOSL, also known as B7-H2) is a cell surface expressed molecule that binds to the ICOS receptor [17]. This intercellular ligand-receptor interaction promotes multimerisation of ICOS on the T cell surface, activating the receptor and stimulating downstream signalling in the T cell. In effector T cells, this receptor activation stimulates the effector T cell response.

Anti-ICOS antibodies may act as agonists of ICOS, mimicking and even surpassing this stimulatory effect of the native ICOS ligand on the receptor. Such agonism may result from ability of the antibody to promote multimerisation of ICOS on the T cell. One mechanism for this is where the antibodies form intercellular bridges between ICOS on the T cell surface and receptors on an adjacent cell (e.g., B cell, antigen-presenting cell, or other immune cell), such as Fc receptors. Another mechanism is where antibodies having multiple (e.g., two) antigen-binding sites (e.g., two VH-VL domain pairs) bridge multiple ICOS receptor molecules and so promote multimerisation. A combination of these mechanisms may occur.

Agonism can be tested for in in vitro T cell activation assays, using antibody in soluble form (e.g., in immunoglobulin format or other antibody format comprising two spatially separated antigen-binding sites, e.g., two VH-VL pairs), either including or excluding a cross-linking agent, or using antibody bound to a solid surface to provide a tethered array of antigen-binding sites. Agonism assays may use a human ICOS positive T lymphocyte cell line such as MJ cells (ATCC CRL-8294) as the target T cell for activation in such assays. One or more measures of T cell activation can be determined for a test antibody and compared with a reference molecule or a negative control to determine whether there is a statistically significant (p<0.05) difference in T cell activation effected by the test antibody compared with the reference molecule or the control. One suitable measure of T cell activation is production of cytokines, e.g., IFNγ, TNFα or IL-2. The skilled person will include suitable controls as appropriate, standardising assay conditions between test antibody and control. A suitable negative control is an antibody in the same format (e.g., isotype control) that does not bind ICOS, e.g., an antibody specific for an antigen that is not present in the assay system. A significant difference is observed for test antibody relative to a cognate isotype control within the dynamic range of the assay is indicative that the antibody acts as an agonist of the ICOS receptor in that assay.

An agonist antibody may be defined as one which, when tested in a T cell activation assay:

has a significantly lower EC50 for induction of IFNγ production compared with control antibody;

induces significantly higher maximal IFNγ production compared with control antibody;

has a significantly lower EC50 for induction of IFNγ production compared with ICOSL-Fc;

induces significantly higher maximal IFNγ production compared with ICOSL-Fc;

has a significantly lower EC50 for induction of IFNγ production compared with reference antibody C398.4A; and/or induces significantly higher maximal IFNγ production compared with reference antibody C398.4A.

In vitro T cell assays include the bead-bound assay of Example 13, the plate-bound assay of Example 14 and the soluble form assay of Example 15.

A significantly lower or significantly higher value may for example be up to 0.5-fold different, up to 0.75-fold different, up to 2-fold different, up to 3-fold different, up to 4-fold different or up to 5-fold different, compared with the reference or control value.

Thus, in one example, an antibody according to the present invention has a significantly lower, e.g., at least 2-fold lower, EC50 for induction of IFNγ in an MJ cell activation assay using the antibody in bead-bound format, compared with control.

The bead-bound assay uses the antibody (and, for control or reference experiments, the control antibody, reference antibody or ICOSL-Fc) bound to the surface of beads. Magnetic beads may be used, and various kinds are commercially available, e.g., Tosyl-activated DYNABEADS M-450 (DYNAL Inc, 5 Delaware Drive, Lake Success, N.Y. 11042 Prod No. 140.03, 140.04). Beads may be coated as described in Example 13, or generally by dissolving the coating material in carbonate buffer (pH 9.6, 0.2 M) or other method known in the art. Use of beads conveniently allows the quantity of protein bound to the bead surface to be determined with a good degree of accuracy. Standard Fc-protein quantification methods can be used for coupled protein quantification on beads. Any suitable method can be used, with reference to a relevant standard within the dynamic range of the assay. DELFIA is exemplified in Example 13, but ELISA or other methods could be used.

Agonism activity of an antibody can also be measured in primary human T lymphocytes ex vivo. The ability of an antibody to induce expression of IFNγ in such T cells is indicative of ICOS agonism. Described herein are two T cell activation assays using primary cells—see Example 2, T cell activation assay 1 and T cell activation assay 2. Preferably, an antibody will show significant (p<0.05) induction of IFNγ at 5 μg/ml compared with control antibody in T cell activation assay 1 and/or T cell activation assay 2. As noted above, an anti-ICOS antibody may stimulate T cell activation to a greater degree than ICOS-L or C398.4 in such an assay. Thus, the antibody may show significantly (p<0.05) greater induction of IFNγ at 5 μg/ml compared with the control or reference antibody in T cell activation assay 1 or 2. TNFα or IL-2 induction may be measured as an alternative assay readout.

Agonism of an anti-ICOS antibody may contribute to its ability to change the balance between populations of TReg and TEff cells in vivo, e.g., in a site of pathology such as a tumour microenvironment, in favour of TEff cells. The ability of an antibody to enhance tumour cell killing by activated ICOS-positive effector T cells may be determined, as discussed elsewhere herein.

T Cell Dependent Killing

Effector T cell function can be determined in a biologically relevant context using an in vitro co-culture assay where tumour cells are incubated with relevant immune cells to trigger immune cell-dependent killing, in which the effect of an anti-ICOS antibody on tumour cell killing by TEffs is observed.

The ability of an antibody to enhance tumour cell killing by activated ICOS-positive effector T cells may be determined. An anti-ICOS antibody may stimulate significantly greater (p<0.05) tumour cell killing compared with a control antibody. An anti-ICOS antibody may stimulate similar or greater tumour cell killing in such an assay as compared with a reference molecule such as the ICOS ligand or the C398.4 antibody. A similar degree of tumour cell killing can be represented as the assay readout for the test antibody being less than two-fold different from that for the reference molecule.

ICOS Ligand-Receptor Neutralisation Potency

An antibody according to the present invention may be one which inhibits binding of ICOS to its ligand ICOSL.

The degree to which an antibody inhibits binding of the ICOS receptor to its ligand is referred to as its ligand-receptor neutralising potency. Potency is normally expressed as an IC50 value, in pM unless otherwise stated. In ligand-binding studies, IC50 is the concentration that reduces receptor binding by 50% of maximal specific binding level. IC50 may be calculated by plotting % specific receptor binding as a function of the log of the antibody concentration, and using a software program such as Prism (GraphPad) to fit a sigmoidal function to the data to generate IC50 values. Neutralising potency may be determined in an HTRF assay. A detailed working example of an HTRF assay for ligand-receptor neutralising potency is set out in Example 8.

An IC50 value may represent the mean of a plurality of measurements. Thus, for example, IC50 values may be obtained from the results of triplicate experiments, and a mean IC50 value can then be calculated.

An antibody may have an IC50 of 1 mM or less in a ligand-receptor neutralisation assay, e.g., 0.5 mM or less. The IC50 may be, 30 nM or less, 20 nM or less, 10 nM or less, 5 nM or less, 4 nM or less, 3 nM or less or 2 nM or less. The IC50 may be at least 0.1 nM, at least 0.5 nM or at least 1 nM.

Antibodies

As described in more detail in the Examples, we isolated and characterised antibodies of particular interest, designated STIM001, STIM002, STIM002-B, STIM003, STIM004, STIM005, STIM006, STIM007, STIM008 and STIM009. In various aspects of the invention, unless context dictates otherwise, antibodies may be selected from any of these antibodies, or from the sub-set of STIM001, STIM002, STIM003, STIM004 and STIM005. Sequences of each of these antibodies are provided in the appended sequence listing, wherein for each antibody the following sequences are shown: nucleotide sequence encoding VH domain; amino acid sequence of VH domain; VH CDR1 amino acid sequence, VH CDR2 amino acid sequence; VH CDR3 amino acid sequence; nucleotide sequence encoding VL domain; amino acid sequence of VL domain; VL CDR1 amino acid sequence; VL CDR2 amino acid sequence; and VL CDR3 amino acid sequence, respectively. The present invention encompasses anti-ICOS antibodies having the VH and/or VL domain sequences of all antibodies shown in the appended sequence listing and/or in the drawings, as well as antibodies comprising the HCDRs and/or LCDRs of those antibodies, and optionally having the full heavy chain and/or full light chain amino acid sequence.

STIM001 has a heavy chain variable region ($V_H$) amino acid sequence of Seq ID No:366, comprising the CDRH1 amino acid sequence of Seq ID No:363, the CDRH2 amino acid sequence of Seq ID No:364, and the CDRH3 amino acid sequence of Seq ID No:365. The heavy chain nucleic acid sequence of the $V_H$ domain is Seq ID No:367. STIM001 has a light chain variable region ($V_L$) amino acid sequence of Seq ID No:373, comprising the CDRL1 amino acid sequence of Seq ID No:370, the CDRL2 amino acid sequence of Seq ID No:371, and the CDRL3 amino acid sequence of Seq ID No:372. The light chain nucleic acid sequence of the $V_L$ domain is Seq ID No:374. The $V_H$ domain may be combined with any of the heavy chain constant region sequences described herein, e.g. Seq ID No:193, Seq ID No:195, Seq ID No:197, Seq ID No:199, Seq ID No:201, Seq ID No:203, Seq ID No:205, Seq ID No:340, Seq ID No:524, Seq ID No:526, Seq ID No:528, Seq ID No:530, Seq ID No:532 or Seq ID No:534. The $V_L$ domain may be combined with any of the light chain constant region sequences described herein, e.g. Seq ID Nos:207, 209, 211, 213, 215, 217, 219, 221, 223, 225, 227, 229, 231, 233, 235, 237, 536 and 538. A full length heavy chain amino acid sequence is Seq ID No:368 (heavy chain nucleic acid sequence Seq ID No:369). A full length light chain amino acid sequence is Seq ID No:375 (light chain nucleic acid sequence Seq ID No:376).

STIM002 has a heavy chain variable region ($V_H$) amino acid sequence of Seq ID No:380, comprising the CDRH1 amino acid sequence of Seq ID No:377, the CDRH2 amino acid sequence of Seq ID No:378, and the CDRH3 amino acid sequence of Seq ID No:379. The heavy chain nucleic acid sequence of the $V_H$ domain is Seq ID No:381. STIM002 has a light chain variable region ($V_L$) amino acid sequence of Seq ID No:387, comprising the CDRL1 amino acid sequence of Seq ID No:384, the CDRL2 amino acid sequence of Seq ID No:385, and the CDRL3 amino acid sequence of Seq ID No:386. The light chain nucleic acid sequence of the $V_L$ domain is Seq ID No:388 or Seq ID No:519. The $V_H$ domain may be combined with any of the heavy chain constant region sequences described herein, e.g. Seq ID No:193, Seq ID No:195, Seq ID No:197, Seq ID No:199, Seq ID No:201, Seq ID No:203, Seq ID No:205, Seq ID No:340, Seq ID No:524, Seq ID No:526, Seq ID No:528, Seq ID No:530, Seq ID No:532 or Seq ID No:534. The $V_L$ domain may be combined with any of the light chain constant region sequences described herein, e.g. Seq ID Nos:207, 209, 211, 213, 215, 217, 219, 221, 223, 225, 227, 229, 231, 233, 235, 237, 536 and 538. A full length heavy chain amino acid sequence is Seq ID No:382 (heavy chain nucleic acid sequence Seq ID No:383). A full length light chain amino acid sequence is Seq ID No:389 (light chain nucleic acid sequence Seq ID No:390 or Seq ID NO:520).

STIM002-B has a heavy chain variable region ($V_H$) amino acid sequence of Seq ID No:394, comprising the CDRH1 amino acid sequence of Seq ID No:391, the CDRH2 amino acid sequence of Seq ID No:392, and the CDRH3 amino acid sequence of Seq ID No:393. The heavy chain nucleic acid sequence of the $V_H$ domain is Seq ID No:395. STIM002-B has a light chain variable region ($V_L$) amino acid sequence of Seq ID No:401, comprising the CDRL1 amino acid sequence of Seq ID No:398, the CDRL2 amino acid sequence of Seq ID No:399, and the CDRL3 amino acid sequence of Seq ID No:400. The light chain nucleic acid sequence of the $V_L$ domain is Seq ID No:402. The $V_H$ domain may be combined with any of the heavy chain constant region sequences described herein, e.g. Seq ID No:193, Seq ID No:195, Seq ID No:197, Seq ID No:199, Seq ID No:201, Seq ID No:203, Seq ID No:205, Seq ID No:340, Seq ID No:524, Seq ID No:526, Seq ID No:528, Seq ID No:530, Seq ID No:532 or Seq ID No:534. The $V_L$ domain may be combined with any of the light chain constant region sequences described herein, e.g. Seq ID Nos:207, 209, 211, 213, 215, 217, 219, 221, 223, 225, 227, 229, 231, 233, 235, 237, 536 and 538. A full length heavy chain amino acid sequence is Seq ID No:396 (heavy chain nucleic acid sequence Seq ID No:397). A full length light chain amino acid sequence is Seq ID No:403 (light chain nucleic acid sequence Seq ID No:404).

STIM003 has a heavy chain variable region ($V_H$) amino acid sequence of Seq ID No:408, comprising the CDRH1 amino acid sequence of Seq ID No:405, the CDRH2 amino acid sequence of Seq ID No:406, and the CDRH3 amino acid sequence of Seq ID No:407. The heavy chain nucleic acid sequence of the V$_H$ domain is Seq ID No:409 or Seq ID No:521. STIM003 has a light chain variable region (V$_L$) amino acid sequence of Seq ID No:415, comprising the CDRL1 amino acid sequence of Seq ID No:412, the CDRL2 amino acid sequence of Seq ID No:413, and the CDRL3 amino acid sequence of Seq ID No:414. The light chain nucleic acid sequence of the V$_L$ domain is Seq ID No:4416. The V$_H$ domain may be combined with any of the heavy chain constant region sequences described herein, e.g. Seq ID No:193, Seq ID No:195, Seq ID No:197, Seq ID No:199, Seq ID No:201, Seq ID No:203, Seq ID No:205, Seq ID No:340, Seq ID No:524, Seq ID No:526, Seq ID No:528, Seq ID No:530, Seq ID No:532 or Seq ID No:534. The V$_L$ domain may be combined with any of the light chain constant region sequences described herein, e.g. Seq ID Nos:207, 209, 211, 213, 215, 217, 219, 221, 223, 225, 227, 229, 231, 233, 235, 237, 536 and 538. A full length heavy chain amino acid sequence is Seq ID No:410 (heavy chain nucleic acid sequence Seq ID No:411 or Seq ID No:522). A full length light chain amino acid sequence is Seq ID No:417 (light chain nucleic acid sequence Seq ID No:418).

STIM004 has a heavy chain variable region (V$_H$) amino acid sequence of Seq ID No:422, comprising the CDRH1 amino acid sequence of Seq ID No:419, the CDRH2 amino acid sequence of Seq ID No:420, and the CDRH3 amino acid sequence of Seq ID No:421. The heavy chain nucleic acid sequence of the V$_H$ domain is Seq ID No:423. STIM004 has a light chain variable region (V$_L$) amino acid sequence of Seq ID No:429, comprising the CDRL1 amino acid sequence of Seq ID No:426, the CDRL2 amino acid sequence of Seq ID No:427, and the CDRL3 amino acid sequence of Seq ID No:428. The light chain nucleic acid sequence of the V$_L$ domain is Seq ID No:430 or Seq ID No:431. The V$_H$ domain may be combined with any of the heavy chain constant region sequences described herein, e.g. Seq ID No:193, Seq ID No:195, Seq ID No:197, Seq ID No:199, Seq ID No:201, Seq ID No:203, Seq ID No:205, Seq ID No:340, Seq ID No:524, Seq ID No:526, Seq ID No:528, Seq ID No:530, Seq ID No:532 or Seq ID No:534. The V$_L$ domain may be combined with any of the light chain constant region sequences described herein, e.g. Seq ID Nos:207, 209, 211, 213, 215, 217, 219, 221, 223, 225, 227, 229, 231, 233, 235, 237, 536 and 538. A full length heavy chain amino acid sequence is Seq ID No:424 (heavy chain nucleic acid sequence Seq ID No:425). A full length light chain amino acid sequence is Seq ID No:432 (light chain nucleic acid sequence Seq ID No:433 or Seq ID no: 434).

STIM005 has a heavy chain variable region (V$_H$) amino acid sequence of Seq ID No:438, comprising the CDRH1 amino acid sequence of Seq ID No:435, the CDRH2 amino acid sequence of Seq ID No:436, and the CDRH3 amino acid sequence of Seq ID No:437. The heavy chain nucleic acid sequence of the V$_H$ domain is Seq ID No:439. STIM005 has a light chain variable region (V$_L$) amino acid sequence of Seq ID No:445, comprising the CDRL1 amino acid sequence of Seq ID No:442, the CDRL2 amino acid sequence of Seq ID No:443, and the CDRL3 amino acid sequence of Seq ID No:444. The light chain nucleic acid sequence of the V$_L$ domain is Seq ID No:446. The V$_H$ domain may be combined with any of the heavy chain constant region sequences described herein, e.g. Seq ID No:193, Seq ID No:195, Seq ID No:197, Seq ID No:199, Seq ID No:201, Seq ID No:203, Seq ID No:205, Seq ID No:340, Seq ID No:524, Seq ID No:526, Seq ID No:528, Seq ID No:530, Seq ID No:532 or Seq ID No:534. The V$_L$ domain may be combined with any of the light chain constant region sequences described herein, e.g. Seq ID Nos:207, 209, 211, 213, 215, 217, 219, 221, 223, 225, 227, 229, 231, 233, 235, 237, 536 and 538. A full length heavy chain amino acid sequence is Seq ID No:440 (heavy chain nucleic acid sequence Seq ID No:441). A full length light chain amino acid sequence is Seq ID No:447 (light chain nucleic acid sequence Seq ID No:448).

STIM006 has a heavy chain variable region (V$_H$) amino acid sequence of Seq ID No:452, comprising the CDRH1 amino acid sequence of Seq ID No:449, the CDRH2 amino acid sequence of Seq ID No:450, and the CDRH3 amino acid sequence of Seq ID No:451. The heavy chain nucleic acid sequence of the V$_H$ domain is Seq ID No:453. STIM006 has a light chain variable region (V$_L$) amino acid sequence of Seq ID No:459, comprising the CDRL1 amino acid sequence of Seq ID No:456, the CDRL2 amino acid sequence of Seq ID No:457, and the CDRL3 amino acid sequence of Seq ID No:458. The light chain nucleic acid sequence of the V$_L$ domain is Seq ID No:460. The V$_H$ domain may be combined with any of the heavy chain constant region sequences described herein, e.g. Seq ID No:193, Seq ID No:195, Seq ID No:197, Seq ID No:199, Seq ID No:201, Seq ID No:203, Seq ID No:205, Seq ID No:340, Seq ID No:524, Seq ID No:526, Seq ID No:528, Seq ID No:530, Seq ID No:532 or Seq ID No:534. The V$_L$ domain may be combined with any of the light chain constant region sequences described herein, e.g. Seq ID Nos:207, 209, 211, 213, 215, 217, 219, 221, 223, 225, 227, 229, 231, 233, 235, 237, 536 and 538. A full length heavy chain amino acid sequence is Seq ID No:454 (heavy chain nucleic acid sequence Seq ID No:455). A full length light chain amino acid sequence is Seq ID No:461 (light chain nucleic acid sequence Seq ID No:462).

STIM007 has a heavy chain variable region (V$_H$) amino acid sequence of Seq ID No:466, comprising the CDRH1 amino acid sequence of Seq ID No:463, the CDRH2 amino acid sequence of Seq ID No:464, and the CDRH3 amino acid sequence of Seq ID No:465. The heavy chain nucleic acid sequence of the V$_H$ domain is Seq ID No:467. STIM007 has a light chain variable region (V$_L$) amino acid sequence of Seq ID No:473, comprising the CDRL1 amino acid sequence of Seq ID No:470, the CDRL2 amino acid sequence of Seq ID No:471, and the CDRL3 amino acid sequence of Seq ID No:472. The light chain nucleic acid sequence of the V$_L$ domain is Seq ID No:474. The V$_H$ domain may be combined with any of the heavy chain constant region sequences described herein, e.g. Seq ID No:193, Seq ID No:195, Seq ID No:197, Seq ID No:199, Seq ID No:201, Seq ID No:203, Seq ID No:205, Seq ID No:340, Seq ID No:524, Seq ID No:526, Seq ID No:528, Seq ID No:530, Seq ID No:532 or Seq ID No:534. The V$_L$ domain may be combined with any of the light chain constant region sequences described herein, e.g. Seq ID Nos:207, 209, 211, 213, 215, 217, 219, 221, 223, 225, 227, 229, 231, 233, 235, 237, 536 and 538. A full length heavy chain amino acid sequence is Seq ID No:468 (heavy chain nucleic acid sequence Seq ID No:469). A full length light chain amino acid sequence is Seq ID No:475 (light chain nucleic acid sequence Seq ID No:476).

STIM008 has a heavy chain variable region (V$_H$) amino acid sequence of Seq ID No:480, comprising the CDRH1 amino acid sequence of Seq ID No:477, the CDRH2 amino acid sequence of Seq ID No:478, and the CDRH3 amino acid sequence of Seq ID No:479. The heavy chain nucleic acid sequence of the V$_H$ domain is Seq ID No:481. STIM008 has a light chain variable region (V$_L$) amino acid sequence of Seq ID No:487, comprising the CDRL1 amino acid sequence of Seq ID No:484, the CDRL2 amino acid sequence of Seq ID No:485, and the CDRL3 amino acid sequence of Seq ID No:486. The light chain nucleic acid sequence of the $V_L$ domain is Seq ID No:488. The $V_H$ domain may be combined with any of the heavy chain constant region sequences described herein, e.g. Seq ID No:193, Seq ID No:195, Seq ID No:197, Seq ID No:199, Seq ID No:201, Seq ID No:203, Seq ID No:205, Seq ID No:340, Seq ID No:524, Seq ID No:526, Seq ID No:528, Seq ID No:530, Seq ID No:532 or Seq ID No:534. The $V_L$ domain may be combined with any of the light chain constant region sequences described herein, e.g. Seq ID Nos:207, 209, 211, 213, 215, 217, 219, 221, 223, 225, 227, 229, 231, 233, 235, 237, 536 and 538. A full length heavy chain amino acid sequence is Seq ID No:482 (heavy chain nucleic acid sequence Seq ID No:483). A full length light chain amino acid sequence is Seq ID No:489 (light chain nucleic acid sequence Seq ID No:490).

STIM009 has a heavy chain variable region ($V_H$) amino acid sequence of Seq ID No:494, comprising the CDRH1 amino acid sequence of Seq ID No:491, the CDRH2 amino acid sequence of Seq ID No:492, and the CDRH3 amino acid sequence of Seq ID No:493. The heavy chain nucleic acid sequence of the $V_H$ domain is Seq ID No:495. STIM009 has a light chain variable region ($V_L$) amino acid sequence of Seq ID No:501, comprising the CDRL1 amino acid sequence of Seq ID No:498, the CDRL2 amino acid sequence of Seq ID No:499, and the CDRL3 amino acid sequence of Seq ID No:500. The light chain nucleic acid sequence of the $V_L$ domain is Seq ID No:502. The $V_H$ domain may be combined with any of the heavy chain constant region sequences described herein, e.g. Seq ID No:193, Seq ID No:195, Seq ID No:197, Seq ID No:199, Seq ID No:201, Seq ID No:203, Seq ID No:205, Seq ID No:340, Seq ID No:524, Seq ID No:526, Seq ID No:528, Seq ID No:530, Seq ID No:532 or Seq ID No:534. The $V_L$ domain may be combined with any of the light chain constant region sequences described herein, e.g. Seq ID Nos:207, 209, 211, 213, 215, 217, 219, 221, 223, 225, 227, 229, 231, 233, 235, 237, 536 and 538. A full length heavy chain amino acid sequence is Seq ID No:496 (heavy chain nucleic acid sequence Seq ID No:497). A full length light chain amino acid sequence is Seq ID No:503 (light chain nucleic acid sequence Seq ID No:504).

Antibodies according to the present invention are immunoglobulins or molecules comprising immunoglobulin domains, whether natural or partly or wholly synthetically produced. Antibodies may be IgG, IgM, IgA, IgD or IgE molecules or antigen-specific antibody fragments thereof (including, but not limited to, a Fab, F(ab')2, Fv, disulphide linked Fv, scFv, single domain antibody, closed conformation multispecific antibody, disulphide-linked scfv, diabody), whether derived from any species that naturally produces an antibody, or created by recombinant DNA technology; whether isolated from serum, B-cells, hybridomas, transfectomas, yeast or bacteria. Antibodies can be humanised using routine technology. The term antibody covers any polypeptide or protein comprising an antibody antigen-binding site. An antigen-binding site (paratope) is the part of an antibody that binds to and is complementary to the epitope of its target antigen (ICOS).

The term "epitope" refers to a region of an antigen that is bound by an antibody. Epitopes may be defined as structural or functional. Functional epitopes are generally a subset of the structural epitopes and have those residues that directly contribute to the affinity of the interaction. Epitopes may also be conformational, that is, composed of non-linear amino acids. In certain embodiments, epitopes may include determinants that are chemically active surface groupings of molecules such as amino acids, sugar side chains, phosphoryl groups, or sulfonyl groups, and, in certain embodiments, may have specific three-dimensional structural characteristics, and/or specific charge characteristics.

The antigen binding site is a polypeptide or domain that comprises one or more CDRs of an antibody and is capable of binding the antigen. For example, the polypeptide comprises a CDR3 (e.g., HCDR3). For example the polypeptide comprises CDRs 1 and 2 (e.g., HCDR1 and 2) or CDRs 1-3 of a variable domain of an antibody (e.g., HCDRs1-3).

An antibody antigen-binding site may be provided by one or more antibody variable domains. In an example, the antibody binding site is provided by a single variable domain, e.g., a heavy chain variable domain (VH domain) or a light chain variable domain (VL domain). In another example, the binding site comprises a VH/VL pair or two or more of such pairs. Thus, an antibody antigen-binding site may comprise a VH and a VL.

The antibody may be a whole immunoglobulin, including constant regions, or may be an antibody fragment. An antibody fragment is a portion of an intact antibody, for example comprising the antigen binding and/or variable region of the intact antibody. Examples of antibody fragments include:
(i) a Fab fragment, a monovalent fragment consisting of the VL, VH, CL and CH1 domains; (ii) a F(ab')2 fragment, a bivalent fragment including two Fab fragments linked by a disulfide bridge at the hinge region;
(iii) an Fd fragment consisting of the VH and CH1 domains;
(iv) an Fv fragment consisting of the VL and VH domains of a single arm of an antibody,
(v) a dAb fragment (Ward et al., (1989) Nature 341:544-546; which is incorporated by reference herein in its entirety), which consists of a VH or VL domain; and
(vi) an isolated complementarity determining region (CDR) that retains specific antigen-binding functionality.

Further examples of antibodies are H2 antibodies that comprise a dimer of a heavy chain (5'-VH-(optional hinge)-CH2-CH3-3') and are devoid of a light chain.

Single-chain antibodies (e.g., scFv) are a commonly used fragment. Multispecific antibodies may be formed from antibody fragments. An antibody of the invention may employ any such format, as appropriate.

Optionally, the antibody immunoglobulin domains may be fused or conjugated to additional polypeptide sequences and/or to labels, tags, toxins or other molecules. Antibody immunoglobulin domains may be fused or conjugated to one or more different antigen binding regions, providing a molecule that is able to bind a second antigen in addition to ICOS. An antibody of the present invention may be a multispecific antibody, e.g., a bispecific antibody, comprising (i) an antibody antigen binding site for ICOS and (ii) a further antigen binding site (optionally an antibody antigen binding site, as described herein) which recognises another antigen (e.g., PD-L1).

An antibody normally comprises an antibody VH and/or VL domain. Isolated VH and VL domains of antibodies are also part of the invention. The antibody variable domains are the portions of the light and heavy chains of antibodies that include amino acid sequences of complementarity determining regions (CDRs; ie., CDR1, CDR2, and CDR3), and framework regions (FRs). Thus, within each of the VH and VL domains are CDRs and FRs. A VH domain comprises a set of HCDRs, and a VL domain comprises a set of LCDRs.

VH refers to the variable domain of the heavy chain. VL refers to the variable domain of the light chain. Each VH and VL is typically composed of three CDRs and four FRs, arranged from amino-terminus to carboxy-terminus in the following order: FR1, CDR1, FR2, CDR2, FR3, CDR3, FR4. According to the methods used in this invention, the amino acid positions assigned to CDRs and FRs may be defined according to Kabat (Sequences of Proteins of Immunological Interest (National Institutes of Health, Bethesda, Md., 1987 and 1991)) or according to IMGT nomenclature. An antibody may comprise an antibody VH domain comprising a VH CDR1, CDR2 and CDR3 and a framework. It may alternatively or also comprise an antibody VL domain comprising a VL CDR1, CDR2 and CDR3 and a framework. Examples of antibody VH and VL domains and CDRs according to the present invention are as listed in the appended sequence listing that forms part of the present disclosure. The CDRs shown in the sequence listing are defined according to the IMGT system [18]. All VH and VL sequences, CDR sequences, sets of CDRs and sets of HCDRs and sets of LCDRs disclosed herein represent aspects and embodiments of the invention. As described herein, a "set of CDRs" comprises CDR1, CDR2 and CDR3. Thus, a set of HCDRs refers to HCDR1, HCDR2 and HCDR3, and a set of LCDRs refers to LCDR1, LCDR2 and LCDR3. Unless otherwise stated, a "set of CDRs" includes HCDRs and LCDRs.

An antibody the invention may comprise one or more CDRs as described herein, e.g. a CDR3, and optionally also a CDR1 and CDR2 to form a set of CDRs. The CDR or set of CDRs may be a CDR or set of CDRs of any of STIM001, STIM002, STIM002-B, STIM003, STIM004, STIM005, STIM006, STIM007, STIM008 and STIM009, or may be a variant thereof as described herein.

The invention provides antibodies comprising an HCDR1, HCDR2 and/or HCDR3 of any of antibodies STIM001, STIM002, STIM002-B, STIM003, STIM004, STIM005, STIM006, STIM007, STIM008 and STIM009 and/or an LCDR1, LCDR2 and/or LCDR3 of any of these antibodies, e.g. a set of CDRs. The antibody may comprise a set of VH CDRs of one of these antibodies. Optionally it may also comprise a set of VL CDRs of one of these antibodies, and the VL CDRs may be from the same or a different antibody as the VH CDRs.

A VH domain comprising a disclosed set of HCDRs, and/or a VL domain comprising a disclosed set of LCDRs, are also provided by the invention.

Typically, a VH domain is paired with a VL domain to provide an antibody antigen-binding site, although as discussed further below a VH or VL domain alone may be used to bind antigen. The STIM003 VH domain may be paired with the STIM003 VL domain, so that an antibody antigen-binding site is formed comprising both the STIM003 VH and VL domains. Analogous embodiments are provided for the other VH and VL domains disclosed herein. In other embodiments, the STIM003 VH is paired with a VL domain other than the STIM003 VL. Light-chain promiscuity is well established in the art. Again, analogous embodiments are provided by the invention for the other VH and VL domains disclosed herein.

Thus, the VH of any of antibodies STIM001, STIM002, STIM003, STIM004 and STIM005 may be paired with the VL of any of antibodies STIM001, STIM002, STIM003, STIM004 and STIM005. Further, the VH of any of antibodies STIM001, STIM002, STIM002-B, STIM003, STIM004, STIM005, STIM006, STIM007, STIM008 and STIM009 may be paired with the VL of any of antibodies STIM001, STIM002, STIM002-B, STIM003, STIM004, STIM005, STIM006, STIM007, STIM008 or STIM009.

An antibody may comprise one or more CDRs, e.g. a set of CDRs, within an antibody framework. The framework regions may be of human germline gene segment sequences. Thus, the antibody may be a human antibody having a VH domain comprising a set of HCDRs in a human germline framework. Normally the antibody also has a VL domain comprising a set of LCDRs, e.g. in a human germline framework. An antibody "gene segment", e.g., a VH gene segment, D gene segment, or JH gene segment refers to oligonucleotide having a nucleic acid sequence from which that portion of an antibody is derived, e.g., a VH gene segment is an oligonucleotide comprising a nucleic acid sequence that corresponds to a polypeptide VH domain from FR1 to part of CDR3. Human V, D and J gene segments recombine to generate the VH domain, and human V and J segments recombine to generate the VL domain. The D domain or region refers to the diversity domain or region of an antibody chain. J domain or region refers to the joining domain or region of an antibody chain. Somatic hypermutation may result in an antibody VH or VL domain having framework regions that do not exactly match or align with the corresponding gene segments, but sequence alignment can be used to identify the closest gene segments and thus identify from which particular combination of gene segments a particular VH or VL domain is derived. When aligning antibody sequences with gene segments, the antibody amino acid sequence may be aligned with the amino acid sequence encoded by the gene segment, or the antibody nucleotide sequence may be aligned directly with the nucleotide sequence of the gene segment.

Alignments of STIM antibody VH and VL domain sequences against related antibodies and against human germline sequences are shown in FIG. 35, FIG. 36 and FIG. 37.

An antibody of the invention may be a human antibody or a chimaeric antibody comprising human variable regions and non-human (e.g., mouse) constant regions. The antibody of the invention for example has human variable regions, and optionally also has human constant regions.

Thus, antibodies optionally include constant regions or parts thereof, e.g., human antibody constant regions or parts thereof. For example, a VL domain may be attached at its C-terminal end to antibody light chain kappa or lambda constant domains. Similarly, an antibody VH domain may be attached at its C-terminal end to all or part (e.g. a CH1 domain or Fc region) of an immunoglobulin heavy chain constant region derived from any antibody isotype, e.g. IgG, IgA, IgE and IgM and any of the isotype sub-classes, such as IgG1 or IgG4.

Examples of human heavy chain constant regions are shown in Table S1.

Constant regions of antibodies of the invention may alternatively be non-human constant regions. For example, when antibodies are generated in transgenic animals (examples of which are described elsewhere herein), chimaeric antibodies may be produced comprising human variable regions and non-human (host animal) constant regions. Some transgenic animals generate fully human antibodies. Others have been engineered to generate antibodies comprising chimaeric heavy chains and fully human light chains. Where antibodies comprise one or more non-human constant regions, these may be replaced with human constant regions to provide antibodies more suitable for administration to humans as therapeutic compositions, as their immunogenicity is thereby reduced.

Digestion of antibodies with the enzyme papain, results in two identical antigen-binding fragments, known also as "Fab" fragments, and a "Fc" fragment, having no antigen-binding activity but having the ability to crystallize. "Fab" when used herein refers to a fragment of an antibody that includes one constant and one variable domain of each of the heavy and light chains. The term "Fc region" herein is used to define a C-terminal region of an immunoglobulin heavy chain, including native-sequence Fc regions and variant Fc regions. The "Fc fragment" refers to the carboxy-terminal portions of both H chains held together by disulfides. The effector functions of antibodies are determined by sequences in the Fc region, the region which is also recognised by Fc receptors (FcR) found on certain types of cells. Digestion of antibodies with the enzyme pepsin, results in the a F(ab')2 fragment in which the two arms of the antibody molecule remain linked and comprise two-antigen binding sites. The F(ab')2 fragment has the ability to crosslink antigen.

"Fv" when used herein refers to the minimum fragment of an antibody that retains both antigen-recognition and antigen-binding sites. This region consists of a dimer of one heavy and one light chain variable domain in tight, non-covalent or covalent association. It is in this configuration that the three CDRs of each variable domain interact to define an antigen-binding site on the surface of the VH-VL dimer. Collectively, the six CDRs confer antigen-binding specificity to the antibody. However, even a single variable domain (or half of an Fv comprising only three CDRs specific for an antigen) has the ability to recognise and bind antigen, although at a lower affinity than the entire binding site.

Antibodies disclosed herein may be modified to increase or decrease serum half-life. In one embodiment, one or more of the following mutations: T252L, T254S or T256F are introduced to increase biological half-life of the antibody. Biological half-life can also be increased by altering the heavy chain constant region $CH_1$ domain or CL region to contain a salvage receptor binding epitope taken from two loops of a $CH_2$ domain of an Fc region of an IgG, as described in U.S. Pat. Nos. 5,869,046 and 6,121,022, the modifications described therein are incorporated herein by reference. In another embodiment, the Fc hinge region of an antibody or antigen-binding fragment of the invention is mutated to decrease the biological half-life of the antibody or fragment. One or more amino acid mutations are introduced into the $CH_2$—$CH_3$ domain interface region of the Fc-hinge fragment such that the antibody or fragment has impaired Staphylococcyl protein A (SpA) binding relative to native Fc-hinge domain SpA binding. Other methods of increasing serum half-life are known to those skilled in the art. Thus, in one embodiment, the antibody or fragment is PEGylated. In another embodiment, the antibody or fragment is fused to an albumin-biding domain, e.g. an albumin binding single domain antibody (dAb). In another embodiment, the antibody or fragment is PASylated (i.e. genetic fusion of polypeptide sequences composed of PAS (XL-Protein GmbH) which forms uncharged random coil structures with large hydrodynamic volume). In another embodiment, the antibody or fragment is XTENylatee/rPEGylated (i.e. genetic fusion of non-exact repeat peptide sequence (Amunix, Versartis) to the therapeutic peptide). In another embodiment, the antibody or fragment is ELPylated (i.e. genetic fusion to ELP repeat sequence (PhaseBio)). These various half-life extending fusions are described in more detail in Strohl, BioDrugs (2015) 29:215-239, which fusions, e.g. in Tables 2 and 6, are incorporated herein by reference.

The antibody may have a modified constant region which increases stabililty. Thus, in one embodiment, the heavy chain constant region comprises a Ser228Pro mutation. In another embodiment, the antibodies and fragments disclosed herein comprise a heavy chain hinge region that has been modified to alter the number of cysteine residues. This modification can be used to facilitate assembly of the light and heavy chains or to increase or decrease the stability of the antibody.

Fc Effector Functions, ADCC, ADCP and CDC

As discussed above, anti-ICOS antibodies can be provided in various isotypes and with different constant regions. Examples of human IgG antibody heavy chain constant region sequences are shown in Table S1. The Fc region of the antibody primarily determines its effector function in terms of Fc binding, antibody-dependent cell-mediated cytotoxicity (ADCC) activity, complement dependent cytotoxicity (CDC) activity and antibody-dependent cell phagocytosis (ADCP) activity. These "cellular effector functions", as distinct from effector T cell function, involve recruitment of cells bearing Fc receptors to the site of the target cells, resulting in killing of the antibody-bound cell. In addition to ADCC and CDC, the ADCP mechanism [19] represents a means of depleting antibody-bound T cells, and thus targeting high ICOS expressing TRegs for deletion.

Cellular effector functions ADCC, ADCP and/or CDC may also be exhibited by antibodies lacking Fc regions. Antibodies may comprise multiple different antigen-binding sites, one directed to ICOS and another directed to a target molecule where engagement of that target molecule induces ADCC, ADCP and/or CDC, e.g., an antibody comprising two scFv regions joined by a linker, where one scFv can engage an effector cell.

An antibody according to the present invention may be one that exhibits ADCC, ADCP and/or CDC. Alternatively, an antibody according to the present invention may lack ADCC, ADCP and/or CDC activity. In either case, an antibody according to the present invention may comprise, or may optionally lack, an Fc region that binds to one or more types of Fc receptor. Use of different antibody formats, and the presence or absence of FcR binding and cellular effector functions, allow the antibody to be tailored for use in particular therapeutic purposes as discussed elsewhere herein.

A suitable antibody format for some therapeutic applications employs a wild-type human IgG1 constant region. A constant region may be an effector-enabled IgG1 constant region, optionally having ADCC and/or CDC and/or ADCP activity. A suitable wild type human IgG1 contant region sequence is SEQ ID NO: 340 (IGHG1*01). Further examples of human IgG1 constant regions are shown in Table S1.

For testing of candidate therapeutic antibodies in mouse models of human disease, an effector positive mouse constant region, such as mouse IgG2a (mIgG2a), may be included instead of an effector positive human constant region.

A constant region may be engineered for enhanced ADCC and/or CDC and/or ADCP.

The potency of Fc-mediated effects may be enhanced by engineering the Fc domain by various established techniques. Such methods increase the affinity for certain Fc-receptors, thus creating potential diverse profiles of activation enhancement. This can achieved by modification of one or several amino acid residues [20]. Human IgG1 constant regions containing specific mutations or altered glycosylation on residue Asn297 (e.g., N297Q, EU index numbering) have been shown to enhance binding to Fc receptors. Example mutations are one or more of the residues selected from 239, 332 and 330 for human IgG1 constant regions (or the equivalent positions in other IgG isotypes). An antibody may thus comprise a human IgG1 constant region having one or more mutations independently selected from N297Q, S239D, I332E and A330L (EU index numbering). A triple mutation (M252Y/S254T/T256E) may be used to enhance binding to FcRn, and other mutations affecting FcRn binding are discussed in Table 2 of [21], any of which may be employed in the present invention.

Increased affinity for Fc receptors can also be achieved by altering the natural glycosylation profile of the Fc domain by, for example, generating under fucosylated or defucosylated variants [22]. Non-fucosylated antibodies harbour a tri-mannosyl core structure of complex-type N-glycans of Fc without fucose residue. These glycoengineered antibodies that lack core fucose residue from the Fc N-glycans may exhibit stronger ADCC than fucosylated equivalents due to enhancement of FcγRIIIa binding capacity. For example, to increase ADCC, residues in the hinge region can be altered to increase binding to Fc-gamma RIII [23]. Thus, an antibody may comprise a human IgG heavy chain constant region that is a variant of a wild-type human IgG heavy chain constant region, wherein the variant human IgG heavy chain constant region binds to human Fcγ receptors selected from the group consisting of FcγRIIB and FcγRIIA with higher affinity than the wild type human IgG heavy chain constant region binds to the human Fcγ receptors. The antibody may comprise a human IgG heavy chain constant region that is a variant of a wild type human IgG heavy chain constant region, wherein the variant human IgG heavy chain constant region binds to human FcγRIIB with higher affinity than the wild type human IgG heavy chain constant region binds to human FcγRIIB. The variant human IgG heavy chain constant region can be a variant human IgG1, a variant human IgG2, or a variant human IgG4 heavy chain constant region. In one embodiment, the variant human IgG heavy chain constant region comprises one or more amino acid mutations selected from G236D, P238D, S239D, S267E, L328F, and L328E (EU index numbering system). In another embodiment, the variant human IgG heavy chain constant region comprises a set of amino acid mutations selected from the group consisting of: S267E and L328F; P238D and L328E; P238D and one or more substitutions selected from the group consisting of E233D, G237D, H268D, P271G, and A330R; P238D, E233D, G237D, H268D, P271G, and A330R; G236D and S267E; S239D and S267E; V262E, S267E, and L328F; and V264E, S267E, and L328F (EU index numbering system). The enhancement of CDC may be achieved by amino acid changes that increase affinity for C1q, the first component of the classic complement activation cascade [24]. Another approach is to create a chimeric Fc domain created from human IgG1 and human IgG3 segments that exploit the higher affinity of IgG3 for C1q [25]. Antibodies of the present invention may comprise mutated amino acids at residues 329, 331 and/or 322 to alter the C1q binding and/or reduced or abolished CDC activity. In another embodiment, the antibodies or antibody fragments disclosed herein may contain Fc regions with modifications at residues 231 and 239, whereby the amino acids are replaced to alter the ability of the antibody to fix complement. In one embodiment, the antibody or fragment has a constant region comprising one or more mutations selected from E345K, E430G, R344D and D356R, in particular a double mutation comprising R344D and D356R (EU index numbering system).

WO2008/137915 described anti-ICOS antibodies with modified Fc regions having enhanced effector function. The antibodies were reported to mediate enhanced ADCC activity as compared to the level of ADCC activity mediated by a parent antibody comprising the VH and VK domains and a wild type Fc region. Antibodies according to the present invention may employ such variant Fc regions having effector function as described therein.

ADCC activity of an antibody may be determined in an assay as described herein. ADCC activity of an anti-ICOS antibody may be determined in vitro using an ICOS positive T cell line as described in Example 10. ADCC activity of an anti-PD-L1 antibody may be determined in vitro in an ADCC assay using PD-L1 expressing cells.

For certain applications (such as in the context of vaccination) it may be preferred to use antibodies without Fc effector function. Antibodies may be provided without a constant region, or without an Fc region—examples of such antibody formats are described elsewhere herein. Alternatively, an antibody may have a constant region which is effector null. An antibody may have a heavy chain constant region that does not bind Fcγ receptors, for example the constant region may comprise a Leu235Glu mutation (i.e., where the wild type leucine residue is mutated to a glutamic acid residue). Another optional mutation for a heavy chain constant region is Ser228Pro, which increases stability. A heavy chain constant region may be an IgG4 comprising both the Leu235Glu mutation and the Ser228Pro mutation. This "IgG4-PE" heavy chain constant region is effector null.

An alternative effector null human constant region is a disabled IgG1. A disabled IgG1 heavy chain constant region may contain alanine at position 235 and/or 237 (EU index numbering), e.g., it may be a IgG1*01 sequence comprising the L235A and/or G237A mutations ("LAGA").

A variant human IgG heavy chain constant region may comprise one or more amino acid mutations that reduce the affinity of the IgG for human FcγRIIIA, human FcγRIIA, or human FcγRI. In one embodiment, the FcγRIIB is expressed on a cell selected from the group consisting of macrophages, monocytes, B-cells, dendritic cells, endothelial cells, and activated T-cells. In one embodiment, the variant human IgG heavy chain constant region comprises one or more of the following amino acid mutations G236A, S239D, F243L, T256A, K290A, R292P, S298A, Y300L, V305I, A330L, I332E, E333A, K334A, A339T, and P396L (EU index numbering system). In one embodiment, the variant human IgG heavy chain constant region comprises a set of amino acid mutations selected from the group consisting of: S239D; T256A; K290A; S298A; I332E; E333A; K334A; A339T; S239D and I332E; S239D, A330L, and I332E; S298A, E333A, and K334A; G236A, S239D, and I332E; and F243L, R292P, Y300L, V305I, and P396L (EU index numbering system). In one embodiment, the variant human IgG heavy chain constant region comprises a S239D, A330L, or I332E amino acid mutations (EU index numbering system). In one embodiment, the variant human IgG heavy chain constant region comprises an S239D and I332E amino acid mutations (EU index numbering system). In one embodiment, the variant human IgG heavy chain constant region is a variant human IgG1 heavy chain constant region comprising the S239D and I332E amino acid mutations (EU index numbering system). In one embodiment, the antibody or fragment comprises an afucosylated Fc region. In another embodiment, the antibody or fragment thereof is defucosylated. In another embodiment, the antibody or fragment is under fucosylated.

An antibody may have a heavy chain constant region that binds one or more types of Fc receptor but does not induce cellular effector functions, i.e., does not mediate ADCC, CDC or ADCP activity. Such a constant region may be unable to bind the particular Fc receptor(s) responsible for triggering ADCC, CDC or ADCP activity.

Generating and Modifying Antibodies

Methods for identifying and preparing antibodies are well known. Antibodies may be generated using transgenic mice (eg, the Kymouse™, Velocimouse®, Omnimouse®, Xenomouse®, HuMab Mouse® or MeMo Mouse®), rats (e.g., the Omnirat®), camelids, sharks, rabbits, chickens or other non-human animals immunised with ICOS or a fragment thereof or a synthetic peptide comprising an ICOS sequence motif of interest, followed optionally by humanisation of the constant regions and/or variable regions to produce human or humanised antibodies. In an example, display technologies can be used, such as yeast, phage or ribosome display, as will be apparent to the skilled person. Standard affinity maturation, e.g., using a display technology, can be performed in a further step after isolation of an antibody lead from a transgenic animal, phage display library or other library. Representative examples of suitable technologies are described in US20120093818 (Amgen, Inc), which is incorporated by reference herein in its entirety, eg, the methods set out in paragraphs [0309] to [0346].

Immunisation of an ICOS knock out non-human animal with human ICOS antigen facilitates the generation of antibodies that recognise both human and non-human ICOS. As described herein and illustrated in the Examples, an ICOS knock out mouse can be immunised with cells expressing human ICOS to stimulate production of antibodies to human and mouse ICOS in the mouse, which can be recovered and tested for binding to human ICOS and to mouse ICOS. Cross-reactive antibodies can thus be selected, which may be screened for other desirable properties as described herein. Methods of generating antibodies to an antigen (e.g., a human antigen), through immunisation of animals with the antigen where expression of the endogenous antigen (e.g, endogenous mouse antigen) has been knocked-out in the animal, may be performed in animals capable of generating antibodies comprising human variable domains. The genomes of such animals can be engineered to comprise a human or humanised immunoglobulin locus encoding human variable region gene segments, and optionally an endogenous constant region or a human constant region. Recombination of the human variable region gene segments generates human antibodies, which may have either a non-human or human constant region. Non-human constant regions may subsequently be replaced by human constant regions where the antibody is intended for in vivo use in humans. Such methods and knock-out transgenic animals are described in WO2013/061078.

Generally, a Kymouse™, VELOCIMMUNE® or other mouse or rat (optionally an ICOS knock out mouse or rat, as noted) can be challenged with the antigen of interest, and lymphatic cells (such as B-cells) are recovered from the mice that express antibodies. The lymphatic cells may be fused with a myeloma cell line to prepare immortal hybridoma cell lines, and such hybridoma cell lines are screened and selected to identify hybridoma cell lines that produce antibodies specific to the antigen of interest. DNA encoding the variable regions of the heavy chain and light chain may be isolated and linked to desirable isotypic constant regions of the heavy chain and light chain. Such an antibody protein may be produced in a cell, such as a CHO cell. Alternatively, DNA encoding the antigen-specific chimaeric antibodies or the variable domains of the light and heavy chains may be isolated directly from antigen-specific lymphocytes.

Initially, high affinity chimaeric antibodies are isolated having a human variable region and a mouse constant region. The antibodies are characterised and selected for desirable characteristics, including affinity, selectivity, agonism, T-cell dependent killing, neutralising potency, epitope, etc. The mouse constant regions are optionally replaced with a desired human constant region to generate the fully human antibody of the invention, for example wild-type or modified IgG1 or IgG4 (for example, SEQ ID NO: 751, 752, 753 in US2011/0065902 (which is incorporated by reference herein in its entirety). While the constant region selected may vary according to specific use, high affinity antigen-binding and target specificity characteristics reside in the variable region.

Thus, in a further aspect, the present invention provides a transgenic non-human mammal having a genome comprising a human or humanised immunoglobulin locus, wherein the mammal does not express ICOS. The mammal may for instance be a knock-out mouse or rat, or other laboratory animal species. Transgenic mice such as the Kymouse™ contain human heavy and light chain immunoglobulin loci inserted at the corresponding endogenous mouse immunoglobulin loci. A transgenic mammal according to the present invention may be one that contains such targeted insertions, or it may contain human heavy and light chain immunoglobulin loci or immunoglobulin genes that are randomly inserted in its genome, inserted at a locus other than the endogenous Ig locus, or provided on an additional chromosome or chromosomal fragment.

Further aspects of the invention are the use of such non-human mammals for producing antibodies to ICOS, and methods of producing antibodies or antibody heavy and/or light chain variable domains in such mammals.

A method of producing an antibody that binds the extracellular domain of human and non-human ICOS may comprise providing a transgenic non-human mammal having a genome comprising a human or humanised immunoglobulin locus, wherein the mammal does not express ICOS, and (a) immunising the mammal with human ICOS antigen (e.g., with cells expressing human ICOS or with purified recombinant ICOS protein);
(b) isolating antibodies generated by the mammal;
(c) testing the antibodies for ability to bind human ICOS and non-human ICOS; and
(d) selecting one or more antibodies that binds both human and non-human ICOS.

Testing for ability to bind human ICOS and non-human ICOS may be done using surface plasmon resonance, HTRF, FACS or any other method described herein. Optionally, binding affinities for human and mouse ICOS are determined. The affinity, or fold-difference in affinity, of binding to human ICOS and mouse ICOS may be determined, and antibodies displaying species cross-reactivity may thus be selected (affinity thresholds and fold-differences that may be used as selection criteria are exemplified elsewhere herein). Neutralising potency, or fold difference in neutralising potency, of the antibody for inhibiting human and mouse ICOS ligand binding to the human and mouse ICOS receptor respectively may also or alternatively be determined as a way to screen for cross-reactive antibodies, e.g., in an HTRF assay. Again, possible thresholds and fold-differences that may be used as selection criteria are exemplified elsewhere herein.

The method may comprise testing the antibodies for ability to bind non-human ICOS from the same species or from a different species as the immunised mammal. Thus, where the transgenic mammal is a mouse (e.g., a Kymouse™), antibodies may be tested for ability to bind mouse ICOS. Where the transgenic mammal is a rat, antibodies may be tested for ability to bind rat ICOS. However, it may be equally useful to determine cross-reactivity of an isolated antibody for non-human ICOS of another species. Thus, antibodies generated in goats may be tested for binding to rat or mouse ICOS. Optionally, binding to goat ICOS may be determined instead or additionally.

In other embodiments, the transgenic non-human mammal may be immunised with non-human ICOS, optionally ICOS of the same mammalian species (e.g., an ICOS knock-out mouse may be immunised with mouse ICOS) instead of human ICOS. Affinity of isolated antibodies for binding to human ICOS and non-human ICOS is then determined in the same way, and antibodies that bind both human and non-human ICOS are selected.

Nucleic acid encoding an antibody heavy chain variable domain and/or an antibody light chain variable domain of a selected antibody may be isolated. Such nucleic acid may encode the full antibody heavy chain and/or light chain, or the variable domain(s) without associated constant region(s). As noted, encoding nucleotide sequences may be obtained directly from antibody-producing cells of a mouse, or B cells may be immortalised or fused to generate hybridomas expressing the antibody, and encoding nucleic acid obtained from such cells. Optionally, nucleic acid encoding the variable domain(s) is then conjugated to a nucleotide sequence encoding a human heavy chain constant region and/or human light chain constant region, to provide nucleic acid encoding a human antibody heavy chain and/or human antibody light chain, e.g., encoding an antibody comprising both the heavy and light chain. As described elsewhere herein, this step is particularly useful where the immunised mammal produces chimaeric antibodies with non-human constant regions, which are preferably replaced with human constant regions to generate an antibody that will be less immunogenic when administered to humans as a medicament. Provision of particular human isotype constant regions is also significant for determining the effector function of the antibody, and a number of suitable heavy chain constant regions are discussed herein.

Other alterations to nucleic acid encoding the antibody heavy and/or light chain variable domain may be performed, such as mutation of residues and generation of variants, as described herein.

The isolated (optionally mutated) nucleic acid may be introduced into host cells, e.g., CHO cells as discussed. Host cells are then cultured under conditions for expression of the antibody, or of the antibody heavy and/or light chain variable domain, in any desired antibody format. Some possible antibody formats are described herein, e.g., whole immunoglobulins, antigen-binding fragments, and other designs.

Variable domain amino acid sequence variants of any of the VH and VL domains or CDRs whose sequences are specifically disclosed herein may be employed in accordance with the present invention, as discussed.

There are many reasons why it may be desirable to create variants, which include optimising the antibody sequence for large-scale manufacturing, facilitating purification, enhancing stability or improving suitability for inclusion in a desired pharmaceutical formulation. Protein engineering work can be performed at one or more target residues in the antibody sequence, e.g., to substituting one amino acid with an alternative amino acid (optionally, generating variants containing all naturally occurring amino acids at this position, with the possible exception of Cys and Met), and monitoring the impact on function and expression to determine the best substitution. It is in some instances undesirable to substitute a residue with Cys or Met, or to introduce these residues into a sequence, as to do so may generate difficulties in manufacturing—for instance through the formation of new intramolecular or intermolecular cysteine-cysteine bonds. Where a lead candidate has been selected and is being optimised for manufacturing and clinical development, it will generally be desirable to change its antigen-binding properties as little as possible, or at least to retain the affinity and potency of the parent molecule. However, variants may also be generated in order to modulate key antibody characteristics such as affinity, cross-reactivity or neutralising potency.

An antibody may comprise a set of H and/or L CDRs of any of the disclosed antibodies with one or more amino acid mutations within the disclosed set of H and/or L CDRs. The mutation may be an amino acid substitution, deletion or insertion. Thus for example there may be one or more amino acid substitutions within the disclosed set of H and/or L CDRs. For example, there may be up to 12, 11, 10, 9, 8, 7, 6, 5, 4, 3 or 2 mutations e.g. substitutions, within the set of H and/or L CDRs. For example, there may be up to 6, 5, 4, 3 or 2 mutations, e.g. substitutions, in HCDR3 and/or there may be up to 6, 5, 4, 3, or 2 mutations, e.g. substitutions, in LCDR3. An antibody may comprise the set of HCDRs, LCDRs or a set of 6 (H and L) CDRs shown for any STIM antibody herein or may comprise that set of CDRs with one or two conservative substitutions.

One or more amino acid mutations may optionally be made in framework regions of an antibody VH or VL domain disclosed herein. For example, one or more residues that differ from the corresponding human germline segment sequence may be reverted to germline. Human germline gene segment sequences corresponding to VH and VL domains of example anti-ICOS antibodies are indicated in Table E12-1, Table E12-2 and Table E12-3, and alignments of antibody VH and VL domains to corresponding germline sequences are shown in the drawings.

An antibody may comprise a VH domain that has at least 60, 70, 80, 85, 90, 95, 98 or 99 amino acid sequence identity with a VH domain of any of the antibodies shown in the appended sequence listing, and/or comprising a VL domain that has at least 60, 70, 80, 85, 90, 95, 98 or 99% amino acid sequence identity with a VL domain of any of those antibodies. Algorithms that can be used to calculate % identity of two amino acid sequences include e.g. BLAST, FASTA, or the Smith-Waterman algorithm, e.g. employing default parameters. Particular variants may include one or more amino acid sequence alterations (addition, deletion, substitution and/or insertion of an amino acid residue).

Alterations may be made in one or more framework regions and/or one or more CDRs. Variants are optionally provided by CDR mutagenesis. The alterations normally do not result in loss of function, so an antibody comprising a thus-altered amino acid sequence may retain an ability to bind ICOS. It may retain the same quantitative binding ability as an antibody in which the alteration is not made, e.g. as measured in an assay described herein. The antibody comprising a thus-altered amino acid sequence may have an improved ability to bind ICOS.

Alteration may comprise replacing one or more amino acid residue with a non-naturally occurring or non-standard amino acid, modifying one or more amino acid residue into a non-naturally occurring or non-standard form, or inserting one or more non-naturally occurring or non-standard amino acid into the sequence. Examples of numbers and locations of alterations in sequences of the invention are described elsewhere herein. Naturally occurring amino acids include the 20 "standard" L-amino acids identified as G, A, V, L, I, M, P, F, W, S, T, N, Q, Y, C, K, R, H, D, E by their standard single-letter codes. Non-standard amino acids include any other residue that may be incorporated into a polypeptide backbone or result from modification of an existing amino acid residue. Non-standard amino acids may be naturally occurring or non-naturally occurring.

The term "variant" as used herein refers to a peptide or nucleic acid that differs from a parent polypeptide or nucleic acid by one or more amino acid or nucleic acid deletions, substitutions or additions, yet retains one or more specific functions or biological activities of the parent molecule. Amino acid substitutions include alterations in which an amino acid is replaced with a different naturally-occurring amino acid residue. Such substitutions may be classified as "conservative", in which case an amino acid residue contained in a polypeptide is replaced with another naturally occurring amino acid of similar character either in relation to polarity, side chain functionality or size. Such conservative substitutions are well known in the art. Substitutions encompassed by the present invention may also be "non-conservative", in which an amino acid residue which is present in a peptide is substituted with an amino acid having different properties, such as naturally-occurring amino acid from a different group (e.g., substituting a charged or hydrophobic amino; acid with alanine), or alternatively, in which a naturally-occurring amino acid is substituted with a non-conventional amino acid. In some embodiments amino acid substitutions are conservative. Also encompassed within the term variant when used with reference to a polynucleotide or polypeptide, refers to a polynucleotide or polypeptide that can vary in primary, secondary, or tertiary structure, as compared to a reference polynucleotide or polypeptide, respectively (e.g., as compared to a wild-type polynucleotide or polypeptide).

In some aspects, one can use "synthetic variants", "recombinant variants", or "chemically modified" polynucleotide variants or polypeptide variants isolated or generated using methods well known in the art. "Modified variants" can include conservative or non-conservative amino acid changes, as described below. Polynucleotide changes can result in amino acid substitutions, additions, deletions, fusions and truncations in the polypeptide encoded by the reference sequence. Some aspects use include insertion variants, deletion variants or substituted variants with substitutions of amino acids, including insertions and substitutions of amino acids and other molecules) that do not normally occur in the peptide sequence that is the basis of the variant, for example but not limited to insertion of ornithine which do not normally occur in human proteins. The term "conservative substitution," when describing a polypeptide, refers to a change in the amino acid composition of the polypeptide that does not substantially alter the polypeptide's activity. For example, a conservative substitution refers to substituting an amino acid residue for a different amino acid residue that has similar chemical properties (e.g., acidic, basic, positively or negatively charged, polar or nonpolar, etc.). Conservative amino acid substitutions include replacement of a leucine with an isoleucine or valine, an aspartate with a glutamate, or a threonine with a serine. Conservative substitution tables providing functionally similar amino acids are well known in the art. For example, the following six groups each contain amino acids that are conservative substitutions for one another: 1) Alanine (A), Serine (S), Threonine (T); 2) Aspartic acid (D), Glutamic acid (E); 3) Asparagine (N), Glutamine (Q); 4) Arginine (R), Lysine (K); 5) Isoleucine (I), Leucine (L), Methionine (M), Valine (V); and 6) Phenylalanine (F), Tyrosine (Y), Tryptophan (W). (See also Creighton, Proteins, W. H. Freeman and Company (1984), incorporated by reference in its entirety.) In some embodiments, individual substitutions, deletions or additions that alter, add or delete a single amino acid or a small percentage of amino acids can also be considered "conservative substitutions" if the change does not reduce the activity of the peptide. Insertions or deletions are typically in the range of about 1 to 5 amino acids. The choice of conservative amino acids may be selected based on the location of the amino acid to be substituted in the peptide, for example if the amino acid is on the exterior of the peptide and expose to solvents, or on the interior and not exposed to solvents.

One can select the amino acid that will substitute an existing amino acid based on the location of the existing amino acid, including its exposure to solvents (i.e., if the amino acid is exposed to solvents or is present on the outer surface of the peptide or polypeptide as compared to internally localized amino acids not exposed to solvents). Selection of such conservative amino acid substitutions are well known in the art, for example as disclosed in Dordo et al, J. Mol Biol, 1999, 217, 721-739 and Taylor et al, J. Theor. Biol. 119(1986); 205-218 and S. French and B. Robson, J. Mol. Evol. 19(1983)171. Accordingly, one can select conservative amino acid substitutions suitable for amino acids on the exterior of a protein or peptide (i.e. amino acids exposed to a solvent), for example, but not limited to, the following substitutions can be used: substitution of Y with F, T with S or K, P with A, E with D or Q, N with D or G, R with K, G with N or A, T with S or K, D with N or E, I with L or V, F with Y, S with T or A, R with K, G with N or A, K with R, A with S, K or P.

In alternative embodiments, one can also select conservative amino acid substitutions encompassed suitable for amino acids on the interior of a protein or peptide, for example one can use suitable conservative substitutions for amino acids is on the interior of a protein or peptide (i.e. the amino acids are not exposed to a solvent), for example but not limited to, one can use the following conservative substitutions: where Y is substituted with F, T with A or S, I with L or V, W with Y, M with L, N with D, G with A, T with A or S, D with N, I with L or V, F with Y or L, S with A or T and A with S, G, T or V. In some embodiments, non-conservative amino acid substitutions are also encompassed within the term of variants.

The invention includes methods of producing antibodies containing VH and/or VL domain variants of the antibody VH and/or VL domains shown in the appended sequence listing. Such antibodies may be produced by a method comprising (i) providing, by way of addition, deletion, substitution or insertion of one or more amino acids in the amino acid sequence of a parent antibody VH domain, an antibody VH domain that is an amino acid sequence variant of the parent antibody VH domain, wherein the parent antibody VH domain is the VH domain of any of antibodies STIM001, STIM002, STIM002-B, STIM003, STIM004, STIM005, STIM006, STIM007, STIM008 and STIM009 or a VH domain comprising the heavy chain complementarity determining regions of any of those antibodies, (ii) optionally combining the VH domain thus provided with a VL domain, to provide a VH/VL combination, and (iii) testing the VH domain or VH/VL domain combination thus provided to identify an antibody with one or more desired characteristics.

Desired characteristics include binding to human ICOS, binding to mouse ICOS, and binding to other non-human ICOS such as cynomolgus ICOS. Antibodies with comparable or higher affinity for human and/or mouse ICOS may be identified. Other desired characteristics include increasing effector T cell function indirectly, via depletion of immunosuppressive TRegs, or directly, via ICOS signalling activation on T effector cells. Identifying an antibody with a desired characteristic may comprise identifying an antibody with a functional attribute described herein, such as its affinity, cross-reactivity, specificity, ICOS receptor agonism, neutralising potency and/or promotion of T cell dependent killing, any of which may be determined in assays as described herein.

When VL domains are included in the method, the VL domain may be a VL domain of any of STIM001, STIM002, STIM002-B, STIM003, STIM004, STIM005, STIM006, STIM007, STIM008 or STIM009, or may be a variant provided by way of addition, deletion, substitution or insertion of one or more amino acids in the amino acid sequence of a parent VL domain, wherein the parent VL domain is the VL domain of any of STIM001, STIM002, STIM002-B, STIM003, STIM004, STIM005, STIM006, STIM007, STIM008 and STIM009 or a VL domain comprising the light chain complementarity determining regions of any of those antibodies.

Methods of generating variant antibodies may optionally comprise producing copies of the antibody or VH/VL domain combination. Methods may further comprise expressing the resultant antibody. It is possible to produce nucleotide sequences corresponding to a desired antibody VH and/or VL domain, optionally in one or more expression vectors. Suitable methods of expression, including recombinant expression in host cells, are set out in detail herein.

Encoding Nucleic Acids and Methods of Expression

Isolated nucleic acid may be provided, encoding antibodies according to the present invention. Nucleic acid may be DNA and/or RNA. Genomic DNA, cDNA, mRNA or other RNA, of synthetic origin, or any combination thereof can encode an antibody.

The present invention provides constructs in the form of plasmids, vectors, transcription or expression cassettes which comprise at least one polynucleotide as above. Exemplary nucleotide sequences are included in the sequence listing. Reference to a nucleotide sequence as set out herein encompasses a DNA molecule with the specified sequence, and encompasses a RNA molecule with the specified sequence in which U is substituted for T, unless context requires otherwise.

The present invention also provides a recombinant host cell that comprises one or more nucleic acids encoding the antibody. Methods of producing the encoded antibody may comprise expression from the nucleic acid, e.g., by culturing recombinant host cells containing the nucleic acid. The antibody may thus be obtained, and may be isolated and/or purified using any suitable technique, then used as appropriate. A method of production may comprise formulating the product into a composition including at least one additional component, such as a pharmaceutically acceptable excipient.

Systems for cloning and expression of a polypeptide in a variety of different host cells are well known. Suitable host cells include bacteria, mammalian cells, plant cells, filamentous fungi, yeast and baculovirus systems and transgenic plants and animals.

The expression of antibodies and antibody fragments in prokaryotic cells is well established in the art. A common bacterial host is *E. coli*. Expression in eukaryotic cells in culture is also available to those skilled in the art as an option for production. Mammalian cell lines available in the art for expression of a heterologous polypeptide include Chinese hamster ovary (CHO) cells, HeLa cells, baby hamster kidney cells, NSO mouse melanoma cells, YB2/0 rat myeloma cells, human embryonic kidney cells, human embryonic retina cells and many others.

Vectors may contain appropriate regulatory sequences, including promoter sequences, terminator sequences, polyadenylation sequences, enhancer sequences, marker genes and other sequences as appropriate. Nucleic acid encoding an antibody can be introduced into a host cell. Nucleic acid can be introduced to eukaryotic cells by various methods, including calcium phosphate transfection, DEAE-Dextran, electroporation, liposome-mediated transfection and transduction using retrovirus or other virus, e.g. vaccinia or, for insect cells, baculovirus. Introducing nucleic acid in the host cell, in particular a eukaryotic cell may use a viral or a plasmid based system. The plasmid system may be maintained episomally or may be incorporated into the host cell or into an artificial chromosome. Incorporation may be either by random or targeted integration of one or more copies at single or multiple loci. For bacterial cells, suitable techniques include calcium chloride transformation, electroporation and transfection using bacteriophage. The introduction may be followed by expressing the nucleic acid, e.g., by culturing host cells under conditions for expression of the gene, then optionally isolating or purifying the antibody.

Nucleic acid of the invention may be integrated into the genome (e.g. chromosome) of the host cell. Integration may be promoted by inclusion of sequences that promote recombination with the genome, in accordance with standard techniques.

The present invention also provides a method that comprises using nucleic acid described herein in an expression system in order to express an antibody.

Therapeutic Use

An antibody described herein may be used in a method of treatment of the human or animal body by therapy. The antibodies find use in increasing effector T cell response, which is of benefit for a range of diseases or conditions, including treating cancers or solid tumours and in the context of vaccination. Increased Teff response may be achieved using an antibody that modulates the balance or ratio between Teffs and Tregs in favour of Teff activity.

Anti-ICOS antibodies may be used for depleting regulatory T cells and/or increasing effector T cell response in a patient, and may be administered to a patient to treat a disease or condition amenable to therapy by depleting regulatory T cells and/or increasing effector T cell response.

An antibody of the present invention, or a composition comprising such an antibody molecule or its encoding nucleic acid, may be used or provided for use in any such method. Use of the antibody, or of a composition comprising it or its encoding nucleic acid, for the manufacture of a medicament for use in any such method is also envisaged. The method typically comprises administering the antibody or composition to a mammal. Suitable formulations and methods of administration are described elsewhere herein.

One envisaged therapeutic use of the antibodies is treatment of cancer. The cancer may be a solid tumour, e.g., renal cell cancer (optionally renal cell carcinoma, e.g., clear cell renal cell carcinoma), head and neck cancer, melanoma (optionally malignant melanoma), non-small cell lung cancer (e.g., adenocarcinoma), bladder cancer, ovarian cancer, cervical cancer, gastric cancer, liver cancer, pancreatic cancer, breast cancer, testicular germ cell carcinoma, or the metastases of a solid tumour such as those listed, or it may be a liquid haematological tumour e.g., lymphoma (such as Hodgkin's lymphoma or Non-Hodgkin's lymphoma, e.g., diffuse large B-cell lymphoma, DLBCL) or leukaemia (e.g., acute myeloid leukaemia). An anti-ICOS antibody may enhance tumour clearance in melanoma, head and neck cancer and non-small cell lung cancer and other cancers with a moderate to high mutational load [26]. By enhancing patients' immune response to their neoplastic lesions, immunotherapy using an anti-ICOS antibody offers the prospect of durable cures or long-term remissions, potentially even in the context of late stage disease.

Cancers are a diverse group of diseases, but anti-ICOS antibodies offer the possibility of treating a range of different cancers by exploiting the patient's own immune system, which has the potential to kill any cancer cell through recognition of mutant or overexpressed epitopes that distinguish cancer cells from normal tissue. By modulating the Teff/Treg balance, anti-ICOS antibodies can enable and/or promote immune recognition and killing of cancer cells. While anti-ICOS antibodies are therefore useful therapeutic agents for a wide variety of cancers, there are particular categories of cancers for which anti-ICOS therapy is especially suited and/or where anti-ICOS therapy can be effective when other therapeutic agents are not.

One such group is cancer that is positive for expression of ICOS ligand. Cancer cells may acquire expression of ICOS ligand, as has been described for melanoma [27]. Expression of ICOS ligand may provide the cells with a selective advantage as the surface-expressed ligand binds ICOS on Tregs, promoting the expansion and activation of the Tregs and thereby suppressing the immune response against the cancer. Cancer cells expressing ICOS ligand may depend for their survival on this suppression of the immune system by Tregs, and would thus be vulnerable to treatment with anti-ICOS antibodies that target the Tregs. This applies also to cancers derived from cells that naturally express ICOS ligand. Continued expression of ICOS ligand by these cells again provides a survival advantage through immune suppression. A cancer expressing ICOS ligand may be derived from antigen-presenting cells such as B cells, dendritic cells and monocytes and may be a liquid haematological tumour such as those mentioned herein. Interestingly it has been shown that these types of cancer are also high in ICOS and FOXP3 expression (TCGA data)—see Example 25. Example 20 herein demonstrates efficacy of exemplary anti-ICOS antibodies in treating tumours derived from cancerous B cells (A20 syngeneic cells) that express ICOS ligand.

Accordingly, anti-ICOS antibodies can be used in methods of treating cancers that are positive for expression of ICOS ligand. Further, a cancer to be treated with anti-ICOS antibody according to the present invention may be one that is positive for expression of ICOS and/or FOXP3, and optionally also expresses ICOS ligand.

Patients may undergo testing to determine whether their cancer is positive for expression of the protein of interest (e.g., ICOS ligand, ICOS and/or FOXP3), for example by taking a test sample (e.g., tumour biopsy) from the patient and determining expression of the protein of interest. Patients whose cancer has been characterised as positive for expression of one, two or all such proteins of interest are selected for treatment with anti-ICOS antibody. As discussed elsewhere herein, anti-ICOS antibody may be used as a monotherapy or in combination with one or more other therapeutic agents.

Anti-ICOS antibodies also offer hope to patients whose cancers are refractory to treatment with antibodies or other drugs directed to immune checkpoint molecules such as CTLA-4, PD-1, PD-L1, CD137, GITR or CD73. These immunotherapies are effective against some cancers but in some cases a cancer may not respond, or it may become unresponsive to continued treatment with the antibody. In common with antibodies to immune checkpoint inhibitors, anti-ICOS antibodies modulate the patient's immune system—nevertheless an anti-ICOS antibody may succeed where such other antibodies fail. It is shown herein that animals carrying A20 B cell lymphomas could be treated with anti-ICOS antibodies to reduce growth of the tumour, shrink the tumour and indeed clear the tumour from the body, whereas treatment with an anti-PD-L1 antibody was no better than control. The A20 cell line has also been reported to be resistant to anti-CTLA-4 [28].

Accordingly, anti-ICOS antibodies can be used in methods of treating cancers that are refractory to treatment with one or more immunotherapies, such as (any or all of) an anti-CTLA-4 antibody, anti-PD1 antibody, anti-PD-L1 antibody, anti-CD137 antibody, anti-GITR antibody, or anti-CD73 antibody. A cancer may be characterised as being refractory to treatment with an antibody or other drug if treatment with that antibody or drug does not significantly reduce growth of the cancer, e.g., if a tumour continues to grow or does not reduce in size or if after a response period the tumour re-initiates its growth. Non-response to a therapeutic agent may be determined ex vivo by testing a sample (e.g., tumour biopsy sample) for cancer cell killing or growth inhibition, and/or in the clinical setting by observing (e.g., using an imaging technology, including MRI) that a patient treated with the therapy is not responding to treatment. Patients whose cancer has been characterised as refractory to treatment with such an immunotherapy are selected for treatment with anti-ICOS antibody.

Further, anti-ICOS antibodies may be used to treat B-cell derived cancer that is resistant to treatment with an anti-CD20 antibody. Anti-ICOS antibodies represent a treatment for cancers that fail to respond to, or become resistant to, therapy with anti-CD20 antibodies like rituximab. Anti-ICOS antibody may be used as a second-line (or further, or additional) treatment for such cancers. The anti-CD20 antibody resistant cancer may be a B cell cancer, e.g., B cell lymphoma, such as diffuse large B cell lymphoma. Resistance of a cancer to anti-CD20 may be determined ex vivo by testing a sample (e.g., tumour biopsy sample) for cancer cell killing or growth inhibition by anti-CD20 antibody, and/or in the clinical setting by observing that a patient treated with the anti-CD20 antibody is not responding to treatment. Alternatively, or additionally, the cancer (e.g., a tumour biopsy sample) may be tested to assess expression of CD20, where an absence or low level of CD20 expression indicates loss of sensitivity to anti-CD20 antibody.

Samples obtained from patients may thus be tested to determine surface expression of a protein of interest, for example ICOS ligand, ICOS, FOXP3 and/or a target receptor to which another therapeutic agent (e.g., anti-receptor antibody) is directed. The target receptor may be CD20 (to which anti-CD20 antibody therapy such as rituximab is directed), or another receptor such as PD1, EGFR, HER2 or HER3. Surface expression of ICOS ligand, ICOS, FOXP3 and/or lack or loss of surface expression of the target receptor is an indication that the cancer is susceptible to anti-ICOS antibody therapy. Anti-ICOS antibodies can be provided for administration to a patient whose cancer is characterised by surface expression of ICOS ligand, ICOS, FOXP3 and/or lack or loss of surface expression of a target receptor, optionally where the patient has been previously treated with anti-CTLA4, anti-PD1, anti-PD-L1 or with an antibody to the target receptor and has not responded or has stopped responding to treatment with that antibody, as measured for example by continued or renewed cancer cell growth, e.g., increase in tumour size.

Any suitable method may be employed to determine whether cancer cells test positive for surface expression of a protein such as ICOS ligand, CD20 or other target receptors mentioned herein. A typical method is immunohistochemistry, where a sample of the cells (e.g., a tumour biopsy sample) is contacted with an antibody for the protein of interest, and binding of antibody is detected using a labelled reagent—typically a second antibody that recognises the Fc region of the first antibody and carries a detectable label such as a fluorescent marker. A sample may be declared to test positive where at least 5% of cells are labelled, as visualised by cell staining or other detection of the label. Optionally a higher cut-off such as 10% or 25% may be used. The antibody will generally be used in excess. Reagent antibodies to the molecules of interest are available or may be generated by straightforward methods. To test for ICOS ligand, the antibody MAB1651 is currently available from R&D systems as a mouse IgG that recognises human ICOS ligand. To test for CD20 expression, rituximab may be used. Detection of mRNA levels of the ICOS ligand or target receptor of interest is an alternative technique [27].

A further indication that a tumour will respond to treatment with anti-ICOS antibody is the presence of Tregs in the tumour microenvironment. Activated Tregs are characterised by ICOS-high and Foxp3-high surface expression. The presence of Tregs in a tumour, especially in elevated numbers, provides a further basis on which a patient may be selected for treatment with anti-ICOS antibody. Tregs may be detected in a tumour biopsy sample ex vivo, for example by immunohistochemistry (assaying for co-expression of both Foxp3 and ICOS, using antibodies to the target protein followed by detection of labels, as described above) or by single cell dispersion of the sample for use in FACS with labelled antibodies to ICOS and Foxp3. FACS methods are exemplified in Example 17 and Example 18.

The anti-ICOS antibodies may be used for treating cancers associated with infectious agents, such as virally-induced cancers. In this category are head and neck squamous cell carcinoma, cervical cancer, Merkel cell carcinoma and many others. Viruses associated with cancer include HBV, HCV, HPV (cervical cancer, oropharyngeal cancer), and EBV (Burkitts lymphomas, gastric cancer, Hodgkin's lymphoma, other EBV positive B cell lymphomas, nasopharyngeal carcinoma and post transplant lymphoproliferative disease). The International Agency for Research on Cancer (Monograph 100B) identified the following major cancer sites associated with infectious agents:

Stomach/Gastric: *Heliobacter pylori*
Liver: Hepatitis B virus, hepatitis C virus (HCV), *Opisthorchis viverrini, Clonorchis sinensis*
Cervix uteri: Human papillomavirus (HPV) with or without HIV
Anogenital (penile, vulva, vagina, anus): HPV with or without HIV
Nasopharynx: Epstein-Barr virus (EBV)
Oropharynx: HPV with or without tobacco or alcohol consumption
Kaposi's sarcoma: Human herpes virus type 8 with or without HIV
Non-Hodgkin lymphoma: *H. pylori*, EBV with or without HIV, HCV, human T-cell lymphotropic virus type 1
Hodgkin's lymphoma: EBV with or without HIV
Bladder: *Schistosoma haematobium.*

Antibodies according to the present invention may be used for treating cancer associated with or induced by any of these infectious agents, such as the cancers specified above.

Stimulation of effector T cell response can also contribute to immunity against infectious disease and/or to recovery from infectious disease in a patient. Thus, an anti-ICOS antibody may be used for treating infectious disease by administering the antibody to a patient.

Infectious diseases include those caused by pathogens, e.g., bacterial, fungal, viral or protozoal pathogens, and treatment may be to promote immune response in a patient against the pathogen infection. An example of a bacterial pathogen is tuberculosis. Examples of viral pathogens are hepatitis B and HIV. Examples of protozoal pathogens are *Plasmodium* species, which cause malaria, such as *P. falciparum*.

The antibody may be used for treating infections, e.g., infection by any pathogen mentioned herein. Infection may be persistent or chronic infection. Infection may be localised or systemic. Extended contact between a pathogen and the immune system may lead to exhaustion of the immune system or development of tolerance (manifested for example through increased levels of Tregs, and tipping of the Treg:Teff balance in favour of Tregs) and/or to immune evasion by the pathogen, through evolution and modification of displayed pathogen antigens. These features reflect similar processes that are believed to occur in cancer. Anti-ICOS antibodies present a therapeutic approach to treating infection by a pathogen, e.g., chronic infection, through modulation of the Treg:Teff ratio in favour of Teff and/or other effects described herein.

Treatment may be of patients who have been diagnosed as having an infectious disease or an infection. Alternatively, treatment may be preventative, and administered to a patient to guard against contracting a disease, e.g., as a vaccine, as described elsewhere herein.

It has also been proposed that an immune response, particularly an IFNγ-dependent systemic immune response, could be beneficial for treatment of Alzheimer's disease and other CNS pathologies that share a neuroinflammatory component as part [29]. WO2015/136541 proposed treatment of Alzheimer's disease using an anti-PD-1 antibody. Anti-ICOS antibodies may be used in the treatment of Alzheimer's disease or other neurodegenerative diseases, optionally in combination with one or more other immunomodulators (e.g., antibody to PD-1).

Combination Therapy

Treatment with an immunomodulatory antibody such as anti-CTLA4, anti-PD1 or anti-PDL1, especially one with Fc effector function, may create an environment in which further depletion of ICOS highly expressing immune-suppressive cells is beneficial. It may be advantageous to combine an anti-ICOS antibody with such an immunomodulator to enhance its therapeutic effects.

A patient who has been treated with an immunomodulatory antibody (e.g., anti-PDL-1, anti-PD-1, anti-CTLA-4)

may particularly benefit from treatment with an anti-ICOS antibody. One reason for this is that an immunomodulatory antibody may increase the number of ICOS-positive Tregs (e.g., intratumoural Tregs) in the patient. This effect is also observed with certain other therapeutic agents, such as recombinant IL-2. Anti-ICOS antibody may reduce and/or reverse a surge or rise in ICOS+ Tregs (e.g., intratumoural Tregs) resulting from treatment of the patient with another therapeutic agent. A patient selected for treatment with an anti-ICOS antibody may thus be one who has already received treatment with a first therapeutic agent, the first therapeutic agent being an antibody (e.g., immunomodulator antibody) or other agent (e.g., IL-2) that increases the number of ICOS+ Tregs in the patient.

Immunomodulators with which an anti-ICOS antibody may be combined include antibodies to any of: PDL1 (e.g., avelumab), PD-1 (e.g., pembrolizumab or nivolumab) or CTLA-4 (e.g., ipilimumab or tremelimumab). An anti-ICOS antibody may be combined with pidilizumab. In other embodiments, an anti-ICOS antibody is not administered in combination with anti-CTLA-4 antibody, and/or optionally is administered in combination with a therapeutic antibody that is not an anti-CTLA-4 antibody.

For example, an anti-ICOS antibody may be used in combination therapy with an anti-PDL1 antibody. Preferably, the anti-ICOS antibody is one that mediates ADCC, ADCP and/or CDC. Preferably, the anti-PDL1 antibody is one that mediates ADCC, ADCP and/or CDC. An example of such combination therapy is administration of an anti-ICOS antibody with an anti-PDL1 antibody wherein both antibodies have effector positive constant regions. Thus, the anti-ICOS antibody and the anti-PDL1 antibody may both be able to mediate ADCC, CDC and/or ADCP. Fc effector function and selection of constant regions is described in detail elsewhere herein, but as one example an anti-ICOS human IgG1 may be combined with an anti-PD-L1 human IgG1. The anti-ICOS antibody and/or the anti-PD-L1 antibody may comprise a wild type human IgG1 constant region. Alternatively, the effector positive constant region of an antibody may be one that is engineered for enhanced effector function, e.g., enhanced CDC, ADCC and/or ADCP. Example antibody constant regions, including wild type human IgG1 sequences and mutations that alter effector function, are discussed in detail elsewhere herein.

Anti-PDL1 antibodies with which an anti-ICOS antibody may be combined include:
Anti-PDL1 antibody that inhibits binding of PD-1 to PDL1 and/or inhibits PDL1, optionally as effector positive human IgG1;
Anti-PD-1 antibody that inhibits binding of PD-1 to PDL1 and/or PDL2;
Avelumab, a human IgG1 antibody which inhibits PD-1 binding to PDL-1. See WO2013/079174;
Durvalumab (or "MEDI4736"), a variant human IgG1 antibody having mutations L234A, L235A and 331. See WO2011/066389;
Atezolizumab, a variant human IgG1 antibody having mutations N297A, D356E and L358M. See US2010/0203056;
BMS-936559, a human IgG4 antibody comprising mutation S228P. See WO2007/005874.

Numerous further examples of anti-PD-L1 antibodies are disclosed herein and others are known in the art. Characterisation data for many of the anti-PD-L1 antibodies mentioned here has been published in U.S. Pat. No. 9,567,399 and U.S. Pat. No. 9,617,338, both incorporated by reference herein. Example anti-PD-L1 antibodies have VH and/or VL domains comprising the HCDRs and/or LCDRs of any of 1D05, 84G09, 1D05 HC mutant 1, 1D05 HC mutant 2, 1D05 HC mutant 3, 1D05 HC mutant 4, 1D05 LC mutant 1, 1D05 LC mutant 2, 1D05 LC mutant 3, 411B08, 411C04, 411D07, 385F01, 386H03, 389A03, 413D08, 413G05, 413F09, 414B06 or 416E01 as set out in U.S. Pat. No. 9,567,399 or U.S. Pat. No. 9,617,338. The antibody may comprise the VH and VL domain of any of these antibodies, and may optionally comprise a heavy and/or light chain having the heavy and/or light chain amino acid sequence of any of these antibodies. VH and VL domains of these anti-PD-L1 antibodies are further described elsewhere herein.

Further example anti-PD-L1 antibodies have VH and/or VL domains comprising the HCDRs and/or LCDRs of KN-035, CA-170, FAZ-053, M7824, ABBV-368, LY-3300054, GNS-1480, YW243.55.S70, REGN3504, or of an anti-PD-L1 antibody disclosed in any of WO2017/034916, WO2017/020291, WO2017/020858, WO2017/020801, WO2016/111645, WO2016/197367, WO2016/061142, WO2016/149201, WO2016/000619, WO2016/160792, WO2016/022630, WO2016/007235, WO2015/179654, WO2015/173267, WO2015/181342, WO2015/109124, WO2015/112805, WO2015/061668, WO2014/159562, WO2014/165082, WO2014/100079, WO2014/055897, WO2013/181634, WO2013/173223, WO2013/079174, WO2012/145493, WO2011/066389, WO2010/077634, WO2010/036959, WO2010/089411 and WO2007/005874. The antibody may comprise the VH and VL domain of any of these antibodies, and may optionally comprise a heavy and/or light chain having the heavy and/or light chain amino acid sequence of any of these antibodies. The anti-ICOS antibody which is used in combination therapy with anti-PD-L1 may be an antibody of the present invention as disclosed herein. Alternatively, the anti-ICOS antibody may comprise the CDRs of, or a VH and/or VL domain of, an anti-ICOS antibody disclosed in any of the following publications:
WO2016154177, US2016304610—for example any of antibodies 7F12, 37A10, 35A9, 36E10, 16G10, 37A10S713, 37A10S714, 37A10S715, 37A10S716, 37A10S717, 37A10S718, 16G10S71, 16G10S72, 16G10S73, 16G10S83, 35A9S79, 35A9S710, or 35A9S89;
WO16120789, US2016215059—for example the antibody known as 422.2 and/or H2L5;
WO14033327, EP2892928, US2015239978—for example the antibody known as 314-8 and/or produced from hybridoma CNCM I-4180;
WO12131004, EP2691419, U.S. Pat. No. 9,376,493, US20160264666—for example the antibody Icos145-1 and/or antibody produced by hybridoma CNCM I-4179;
WO10056804—for example the antibody JMAb 136 or "136";
WO9915553, EP1017723B1, U.S. Pat. No. 7,259,247, U.S. Pat. No. 7,132,099, U.S. Pat. No. 7,125,551, U.S. Pat. No. 7,306,800, U.S. Pat. No. 7,722,872, WO05103086, EP1740617, U.S. Pat. No. 8,318,905, U.S. Pat. No. 8,916,155—for example the antibody MIC-944 or 9F3;
WO983821, U.S. Pat. No. 7,932,358B2, US2002156242, EP0984023, EP1502920, U.S. Pat. No. 7,030,225, U.S. Pat. No. 7,045,615, U.S. Pat. No. 7,279,560, U.S. Pat. No. 7,226,909, U.S. Pat. No. 7,196,175, U.S. Pat. No. 7,932,358, U.S. Pat. No. 8,389,690, WO02070010, EP1286668, EP1374901, U.S. Pat. No. 7,438,905, U.S. Pat. No. 7,438,905, WO0187981, EP1158004, U.S. Pat. No. 6,803,039, U.S. Pat. No. 7,166,283, U.S. Pat. No. 7,988,965, WO0115732, EP1125585, U.S. Pat. No. 7,465,445, U.S. Pat. No. 7,998,478—for example any JMAb antibody, e.g., any of JMAb-124, JMAb-126, JMAb-127, JMAb-128, JMAb-135, JMAb-136, JMAb-137, JMAb-138, JMAb-139, JMAb-140, JMAb-141, e.g., JMAb136;
WO2014/089113—for example antibody 17G9;
WO12174338;
US2016145344;
WO11020024, EP2464661, US2016002336, US2016024211, U.S. Pat. No. 8,840,889;
U.S. Pat. No. 8,497,244.

The anti-ICOS antibody optionally comprises the CDRs of 37A10S713 as disclosed in WO2016154177. It may comprise the VH and VL domains of 37A10S713, and may optionally have the antibody heavy and light chains of 37A10S713.

Combination of an anti-ICOS antibody with an immunomodulator may provide an increased therapeutic effect compared with monotherapy, and may allow therapeutic benefit to be achieved with a lower dose of the immunomodulator(s). Thus, for example, an antibody (e.g., anti-PD-L1 antibody, optionally ipilimumab) that is used in combination with anti-ICOS antibody may be dosed at 3 mg/kg rather than a more usual dose of 10 mg/kg. The administration regimen of the anti-PD-L1 or other antibody may involve intravenous administration over a 90 minute period every 3 weeks for a total of 4 doses.

An anti-ICOS antibody may be used to increase the sensitivity of a tumour to treatment with an anti-PD-L1 antibody, which may be recognised as a reduction in the dose at which the anti-PD-L1 antibody exerts a therapeutic benefit. Thus, anti-ICOS antibody may be administered to a patient to reduce the dose of anti-PD-L1 antibody effective to treat cancer or a tumour in the patient. Administration of anti-ICOS antibody may reduce the recommended or required dosage of anti-PD-L1 antibody administration to that patient to, for example, 75%, 50%, 25%, 20%, 10% or less, compared with the dosage when anti-PD-L1 antibody is administered without anti-ICOS. The patient may be treated by administration of anti-ICOS antibody and anti-PD-L1 antibody in a combination therapy as described herein.

The benefit of combining anti-PD-L1 with anti-ICOS may extend to a reduction in dosage of each agent when compared with its use as a monotherapy. Anti-PD-L1 antibody may be used to reduce the dose at which anti-ICOS antibody exerts a therapeutic benefit, and thus may be administered to a patient to reduce the dose of anti-ICOS antibody effective to treat cancer or a tumour in the patient. Thus, an anti-PD-L1 antibody may reduce the recommended or required dosage of anti-ICOS antibody administration to that patient to, for example, 75%, 50%, 25%, 20%, 10% or less, compared with the dosage when anti-ICOS antibody is administered without anti-PD-L1. The patient may be treated by administration of anti-ICOS antibody and anti-PD-L1 antibody in a combination therapy as described herein.

As discussed in Example 22 herein, treatment with anti-PD-L1 antibody, especially antibody with effector positive Fc, appears not to increase the expression of ICOS on Teff cells. This is advantageous when administering such antibodies in combination with effector positive anti-ICOS antibodies, where an increase in ICOS expression on Teffs would undesirably render these cells more sensitive to depletion by the anti-ICOS antibody. In a combination with anti-PD-L1, anti-ICOS therapy may thus exploit a differential expression of ICOS on Teffs compared with Tregs, preferentially targeting the ICOS-high Tregs for depletion. This in turn relieves the suppression of TEffs and has a net effect of promoting the effector T cell response in a patient.

The effect of targeting immune checkpoint molecules on expression of ICOS on T cells has also been studied previously—see Figure S6C in ref. [30] (supplementary materials), where treatment with CTLA-4 antibody and/or anti-PD-1 antibody was reported to increase the percentage of CD4+ Tregs expressing ICOS. The effect of a therapeutic agent on ICOS expression in Tregs and Teffs may be a factor in selection of appropriate agents for use in combination with anti-ICOS antibodies, noting that effect of the anti-ICOS antibody may be enhanced under conditions where there is high differential expression of ICOS on Tregs versus Teffs.

As described herein, a single dose of anti-ICOS antibody may be sufficient to provide therapeutic effect, especially in combination with other therapeutic agents such as anti-PD-L1 antibody. In tumour therapy, the underlying rationale for this single dose benefit may be that the anti-ICOS antibody mediates its effect, at least in part, by resetting or altering the microenvironment of the tumour sufficiently to render the tumour more sensitive to immune attack and/or to the effects of other immunomodulators such as those mentioned. Tumour microenviroment resetting is triggered through for example depletion of ICOS positive tumour infiltrating T-regs. So, for example, a patient may be treated with a single dose of an anti-ICOS antibody followed by one or multiple doses of anti-PD-L1 antibody. Over a period of treatment, for example six months or a year, the anti-ICOS antibody may be administered in a single dose while other agents, e.g., anti-PD-L1 antibody, are optionally administered multiple times over that treatment period, preferably with at least one such dose being administered subsequent to treatment with the anti-ICOS antibody.

Further examples of combination therapy include combination of anti-ICOS antibody with:
 an antagonist of an adenosine A2A receptor ("A2AR inhibitor");
 a CD137 agonist (e.g., agonist antibody);
 an antagonist of the enzyme indoleamine-2,3 dioxygenase, which catalyses the breakdown of tryptophan ("IDO inhibitor"). IDO is an immune checkpoint, activated in dendritic cells and macrophages, which contributes to immune suppression/tolerance.

Anti-ICOS antibodies may be used in combination therapy with IL-2 (e.g., recombinant IL-2 such as aldesleukin). The IL-2 may be administered at high dose (HD). Typical HD IL-2 therapy involves bolus infusion of over 500,000 IU/kg, e.g., bolus infusions of 600,000 or 720,000 IU/kg, per cycle of therapy, where 10-15 such bolus infusions are given at intervals of between 5-10 hours, e.g., up to 15 bolus infusions every 8 hours, and repeating the therapy cycle approximately every 14 to 21 days for up to 6 to 8 cycles. HD IL-2 therapy has been successful in treating tumours, especially melanoma (e.g., metastatic melanoma) and renal cell carcinoma, but its use is limited to the high toxicity of IL-2 which can cause severe adverse effects.

Treatment with high dose IL-2 has been shown to increase the population of ICOS-positive Tregs in cancer patients [31]. This increase in ICOS+ TRegs following the first cycle of HD IL-2 therapy was reported to correlate with worse clinical outcome—the higher the number of ICOS+ Tregs, the worse the prognosis. An IL-2 variant F42K has been proposed as an alternative therapy to avoid this undesirable increase in ICOS+ Treg cells [32]. However, another approach would be to exploit the increase in ICOS+ T regs by using an antibody in accordance with the present invention as a second-line therapeutic agent.

It may be beneficial to combine IL-2 therapy with anti-ICOS antibodies, capitalising on the ability of anti-ICOS antibodies to target TRegs that highly express ICOS, inhibiting these cells and improving the prognosis for patients undergoing IL-2 therapy. Concomitant administration of IL-2 and anti-ICOS antibody may increase the response rate while avoiding or reducing adverse events in the treated patient population. The combination may permit IL-2 to be used at lower dose compared with IL-2 monotherapy, reducing the risk or level of adverse events arising from the IL-2 therapy, while retaining or enhancing clinical benefit (e.g., reduction of tumour growth, clearance of solid tumour and/or reduction of metastasis). In this way, addition of anti-ICOS can improve treatment of patients who are receiving IL-2, whether high-dose (HD) or low-dose (LD) IL-2.

Accordingly, one aspect of the invention provides a method of treating a patient by administering an anti-ICOS antibody to the patient, wherein the patient is also treated with IL-2, e.g., HD IL-2. Another aspect of the invention is an anti-ICOS antibody for use in treating a patient, wherein the patient is also treated with IL-2, e.g., HD IL-2. The anti-ICOS antibody may be used as a second-line therapy. Thus, the patient may be one who has been treated with IL-2, e.g., having received at least one cycle of HD IL-2 therapy, and who has an increased level of ICOS+ Tregs. Assays may be performed on samples of cancer cells, e.g., tumour biopsy samples, using immunohistochemistry or FACS as described elsewhere herein to detect cells positive for ICOS, Foxp3, ICOSL and optionally one or more further markers of interest. Methods may comprise determining that the patient has an increased level of ICOS+ Tregs (e.g., in peripheral blood, or in a tumour biopsy) following IL-2 treatment, where an increased level is indicative that the patient would benefit from treatment with the anti-ICOS antibody. The increase in Tregs may be relative to control (untreated) individuals or to the patient prior to IL-2 therapy. Such patients with elevated Tregs represent a group who may not benefit from continued IL-2 treatment alone, but for whom a combination of anti-ICOS antibody and IL-2 therapy, or treatment with anti-ICOS antibody alone, offers therapeutic benefit. Thus, following a positive determination that the patient has an increased level of ICOS+ Tregs, anti-ICOS antibody and/or further IL-2 therapy may be administered. Treatment with the anti-ICOS antibody may selectively target and deplete the ICOS+ Tregs relative to other T cell populations in such patients. This provides a therapeutic effect by relieving the immunosuppression mediated by these cells and thereby enhancing activity of Teffs against the target cells, e.g., tumour cells or infected cells.

Combination therapy with anti-ICOS antibodies and IL-2 may be used for any therapeutic indication described herein, and particularly for treating a tumour, e.g., melanoma such as metastatic melanoma, or renal cell carcinoma. Thus, in one example, the patient treated with an anti-ICOS antibody is one who presents with metastatic melanoma and has been treated with IL-2, e.g., HD IL-2 therapy or LD IL-2 therapy.

In general, where an anti-ICOS antibody is administered to a patient who has received treatment with a first therapeutic agent (e.g., immunomodulator antibody) or other agent (e.g., IL-2), the anti-ICOS antibody may be administered after a minimum period of, for example, 24 hours, 48 hours, 72 hours, 1 week or 2 weeks following administration of the first therapeutic agent. The anti-ICOS antibody may be administered within 2, 3, 4 or 5 weeks after administration of the first therapeutic agent. This does not exclude additional administrations of either agent at any time, although it may be desirable to minimise the number of treatments administered, for ease of compliance for patients and to reduce costs. Rather, the relative timing of the administrations will be selected to optimise their combined effect, the first therapeutic agent creating an immunological environment (e.g., elevated ICOS+ Tregs, or antigen release as discussed below) in which the effect of the anti-ICOS antibody is especially advantageous. Thus, sequential administration of the first therapeutic agent and then the anti-ICOS antibody may allow time for the first agent to act, creating in vivo conditions in which the anti-ICOS antibody can exhibit its enhanced effect. Various administration regimens, including simultaneous or sequential combination treatments, are described herein and can be utilised as appropriate. Where the first therapeutic agent is one that increases the number of ICOS+ Tregs in the patient, the treatment regimen for the patient may comprise determining that the patient has an increased number of ICOS+ Tregs, and then administering the anti-ICOS antibody.

As noted, use of anti-ICOS antibodies in combination therapy may provide advantages of reducing the effective dose of the therapeutic agents and/or countering adverse effects of therapeutic agents that increase ICOS+ Tregs in patients. Yet further therapeutic benefits may be achieved through selecting a first therapeutic agent that causes release of antigens from target cells through "immunological cell death", and administering the first therapeutic agent in combination with an anti-ICOS antibody. As noted, administration of the anti-ICOS antibody may sequentially follow administration of the first therapeutic agent, administration of the two agents being separated by a certain time window as discussed above.

Immunological cell death is a recognised mode of cell death, contrasting with apoptosis. It is characterised by release of ATP and HMGB1 from the cell and exposure of calreticulin on the plasma membrane [33, 34].

Immunological cell death in a target tissue or in target cells promotes engulfment of the cell by an antigen-presenting cell, resulting in display of antigens from the target cell, which in turn induces antigen-specific Teff cells. Anti-ICOS antibody may increase the magnitude and/or duration of the Teff response by acting as an agonist of ICOS on the Teff cells. In addition, where the anti-ICOS antibody is Fc effector function enabled (e.g., a human IgG1 antibody), the anti-ICOS antibody may cause depletion of antigen-specific Tregs. Thus, through a combination of either or both of these effects, the balance between Teff and Treg cells is modulated in favour of enhancing Teff activity. Combination of an anti-ICOS antibody with a treatment that induces immunological cell death in a target tissue or cell type, such as in a tumour or in cancer cells, thereby promotes an immune response in the patient against the target tissue or cells, representing a form of vaccination in which the vaccine antigen is generated in vivo.

Accordingly, one aspect of the invention is a method of treating cancer in a patient by in vivo vaccination of the patient against their cancer cells. Another aspect of the invention is an anti-ICOS antibody for use in such a method. Anti-ICOS antibodies may be used in a method comprising:

treating the patient with a therapy that causes immunological cell death of the cancer cells, resulting in presentation of antigen to antigen-specific effector T cells, and administering an anti-ICOS antibody to the patient, wherein the anti-ICOS antibody enhances the antigen-specific effector T cell response against the cancer cells.

Treatments that induce immunological cell death include radiation (e.g., ionising irradiation of cells using UVC light or γ rays), chemotherapeutic agents (e.g., oxaliplatin, anthracyclines such as doxorubicin, idarubicin or mitoxantrone, BK channel agonists such as phloretin or pimaric acid, bortezomib, cardiac glycosides, cyclophosphamide, GADD34/PP1 inhibitors with mitomycin, PDT with hypericin, polyinosinic-polycytidylic acid, 5-fluorouracil, gemcitabine, gefitnib, erlotinib, or thapsigargin with cisplatin) and antibodies to tumour-associated antigens. The tumour-associated antigen can be any antigen that is over-expressed by tumour cells relative to non-tumour cells of the same tissue, e.g., HER2, CD20, EGFR. Suitable antibodies include herceptin (anti-HER2), rituximab (anti-CD20), or cetuximab (anti-EGFR).

Thus, it is advantagous to combine an anti-ICOS antibody with one or more such treatments. Optionally, the anti-ICOS antibody is adminstered to a patient who has already received such treatment. The anti-ICOS antibody may be administered after a period of, for example, 24 hours, 48 hours, 72 hours, 1 week or 2 weeks following the treatment that induces immunological cell death, e.g., between 24 to 72 hours after the treatment. The anti-ICOS antibody may be administered within 2, 3, 4 or 5 weeks after the treatment. Other regimens for combination therapy are discussed elsewhere herein.

While "in vivo vaccination" has been described above, it is also possible to treat tumour cells to induce immunological cell death ex vivo, after which the cells may be reintroduced to the patient. Rather than administering the agent or treatment that induces immunological cell death directly to the patient, the treated tumour cells are administered to the patient. Treatment of the patient may be in accordance with administration regimens described above.

As already noted, a single dose of an anti-ICOS antibody may be sufficient to provide therapeutic benefit. Thus, in the methods of treatment described herein, the anti-ICOS antibody is optionally administered as a single dose. A single dose of anti-ICOS antibody may deplete Tregs in a patient, with consequent beneficial effects in diseases such as cancer. It has previously been reported that transient ablation of Tregs has anti-tumour effects, including reducing tumour progression, treating established tumours and metastases and extending survival, and that it can enhance the therapeutic effect of tumour irradiation [35]. Administration of a single dose of anti-ICOS may provide such Treg depletion, and may be used to enhance the effects of other therapeutic approaches used in combination, such as radiotherapy.

Antibodies to PD-L1

An antibody to PD-L1 for use in combination with an anti-ICOS antibody, whether as a separate therapeutic agent or in a multispecific antibody as described herein, may comprise the antigen-binding site of any anti-PD-L1 antibody. Numerous examples of anti-PD-L1 antibodies are disclosed herein and others are known in the art. Characterisation data for many of the anti-PD-L1 antibodies mentioned here has been published in U.S. Pat. No. 9,567,399 and U.S. Pat. No. 9,617,338, both incorporated by reference herein.

1D05 has a heavy chain variable region ($V_H$) amino acid sequence of Seq ID No:33, comprising the CDRH1 amino acid sequence of Seq ID No:27 (IMGT) or Seq ID No:30 (Kabat), the CDRH2 amino acid sequence of Seq ID No:28 (IMGT) or Seq ID No:31 (Kabat), and the CDRH3 amino acid sequence of Seq ID No:29 (IMGT) or Seq ID No:32 (Kabat). The heavy chain nucleic acid sequence of the $V_H$ domain is Seq ID No:34. 1D05 has a light chain variable region ($V_L$) amino acid sequence of Seq ID No:43, comprising the CDRL1 amino acid sequence of Seq ID No:37 (IMGT) or Seq ID No:40 (Kabat), the CDRL2 amino acid sequence of Seq ID No:38 (IMGT) or Seq ID No:41 (Kabat), and the CDRL3 amino acid sequence of Seq ID No:39 (IMGT) or Seq ID No:42 (Kabat). The light chain nucleic acid sequence of the $V_L$ domain is Seq ID No:44. The $V_H$ domain may be combined with any of the heavy chain constant region sequences described herein, e.g. Seq ID No:193, Seq ID No:195, Seq ID No:197, Seq ID No:199, Seq ID No:201, Seq ID No:203, Seq ID No:205, Seq ID No:340, Seq ID No:524, Seq ID No: 526, Seq ID No:528, Seq ID No: 530, Seq ID No: 532 or Seq ID No: 534. The $V_L$ domain may be combined with any of the light chain constant region sequences described herein, e.g. Seq ID Nos:207, 209, 211, 213, 215, 217, 219, 221, 223, 225, 227, 229, 231, 233, 235, 237, 536 and 538. A full length heavy chain amino acid sequence is Seq ID No:35 (heavy chain nucleic acid sequence Seq ID No:36). A full length light chain amino acid sequence is Seq ID No:45 (light chain nucleic acid sequence Seq ID No:46).

84G09 has a heavy chain variable ($V_H$) region amino acid sequence of Seq ID No:13, comprising the CDRH1 amino acid sequence of Seq ID No:7 (IMGT) or Seq ID No:10 (Kabat), the CDRH2 amino acid sequence of Seq ID No:8 (IMGT) or Seq ID No:11 (Kabat), and the CDRH3 amino acid sequence of Seq ID No:9 (IMGT) or Seq ID No:12 (Kabat). The heavy chain nucleic acid sequence of the $V_H$ domain is Seq ID No:14. 84G09 has a light chain variable region ($V_L$) amino acid sequence of Seq ID No:23, comprising the CDRL1 amino acid sequence of Seq ID No:17 (IMGT) or Seq ID No:20 (Kabat), the CDRL2 amino acid sequence of Seq ID No:18 (IMGT) or Seq ID No:21 (Kabat), and the CDRL3 amino acid sequence of Seq ID No:19 (IMGT) or Seq ID No:22 (Kabat). The light chain nucleic acid sequence of the $V_L$ domain is Seq ID No:24. The $V_H$ domain may be combined with any of the heavy chain constant region sequences described herein, e.g. Seq ID No:193, Seq ID No:195, Seq ID No:197, Seq ID No:199, Seq ID No:201, Seq ID No:203, Seq ID No:205, Seq ID No:340, Seq ID No:524, Seq ID No:526, Seq ID No:528, Seq ID No:530, Seq ID No:532 or Seq ID No:534. The $V_L$ domain may be combined with any of the light chain constant region sequences described herein, e.g. Seq ID Nos:207, 209, 211, 213, 215, 217, 219, 221, 223, 225, 227, 229, 231, 233, 235, 237, 536 and 538. A full length heavy chain amino acid sequence is Seq ID No:15 (heavy chain nucleic acid sequence Seq ID No:16). A full length light chain amino acid sequence is Seq ID No:25 (light chain nucleic acid sequence Seq ID No:26).

1D05 HC mutant 1 has a heavy chain variable ($V_H$) region amino acid sequence of Seq ID No:47, comprising the CDRH1 amino acid sequence of Seq ID No:27 (IMGT) or Seq ID No:30 (Kabat), the CDRH2 amino acid sequence of Seq ID No:28 (IMGT) or Seq ID No:31 (Kabat), and the CDRH3 amino acid sequence of Seq ID No:29 (IMGT) or Seq ID No:32 (Kabat). 1D05 HC mutant 1 has a light chain variable region ($V_L$) amino acid sequence of Seq ID No:43, comprising the CDRL1 amino acid sequence of Seq ID No:37 (IMGT) or Seq ID No:40 (Kabat), the CDRL2 amino acid sequence of Seq ID No:38 (IMGT) or Seq ID No:41 (Kabat), and the CDRL3 amino acid sequence of Seq ID No:39 (IMGT) or Seq ID No:42 (Kabat). The light chain nucleic acid sequence of the $V_L$ domain is Seq ID No:44. The $V_H$ domain may be combined with any of the heavy chain constant region sequences described herein, e.g. Seq ID No:193, Seq ID No:195, Seq ID No:197, Seq ID No:199, Seq ID No:201, Seq ID No:203, Seq ID No:205, Seq ID No:340, Seq ID No:524, Seq ID No:526, Seq ID No:528, Seq ID No:530, Seq ID No:532 or Seq ID No:534. The $V_L$ domain may be combined with any of the light chain constant region sequences described herein, e.g. Seq ID Nos:207, 209, 211, 213, 215, 217, 219, 221, 223, 225, 227, 229, 231, 233, 235, 237, 536 and 538. A full length light chain amino acid sequence is Seq ID No:45 (light chain nucleic acid sequence Seq ID No:46).

1D05 HC mutant 2 has a heavy chain variable ($V_H$) region amino acid sequence of Seq ID No:48, comprising the CDRH1 amino acid sequence of Seq ID No:27 (IMGT) or Seq ID No:30 (Kabat), the CDRH2 amino acid sequence of Seq ID No:28 (IMGT) or Seq ID No:31 (Kabat), and the CDRH3 amino acid sequence of Seq ID No:29 (IMGT) or Seq ID No:32 (Kabat). 1D05 HC mutant 2 has a light chain variable region ($V_L$) amino acid sequence of Seq ID No:43, comprising the CDRL1 amino acid sequence of Seq ID No:37 (IMGT) or Seq ID No:40 (Kabat), the CDRL2 amino acid sequence of Seq ID No:38 (IMGT) or Seq ID No:41 (Kabat), and the CDRL3 amino acid sequence of Seq ID No:39 (IMGT) or Seq ID No:42 (Kabat). The light chain nucleic acid sequence of the $V_L$ domain is Seq ID No:44. The $V_H$ domain may be combined with any of the heavy chain constant region sequences described herein, e.g. Seq ID No:193, Seq ID No:195, Seq ID No:197, Seq ID No:199, Seq ID No:201, Seq ID No:203, Seq ID No:205, Seq ID No:340, Seq ID No:524, Seq ID No:526, Seq ID No:528, Seq ID No:530, Seq ID No:532 or Seq ID No:534. The $V_L$ domain may be combined with any of the light chain constant region sequences described herein, e.g. Seq ID Nos:207, 209, 211, 213, 215, 217, 219, 221, 223, 225, 227, 229, 231, 233, 235, 237, 536 and 538. A full length light chain amino acid sequence is Seq ID No:45 (light chain nucleic acid sequence Seq ID No:46).

1D05 HC mutant 3 has a heavy chain variable ($V_H$) region amino acid sequence of Seq ID No:49, comprising the CDRH1 amino acid sequence of Seq ID No:27 (IMGT) or Seq ID No:30 (Kabat), the CDRH2 amino acid sequence of Seq ID No:28 (IMGT) or Seq ID No:31 (Kabat), and the CDRH3 amino acid sequence of Seq ID No:29 (IMGT) or Seq ID No:32 (Kabat). 1D05 HC mutant 3 has a light chain variable region ($V_L$) amino acid sequence of Seq ID No:43, comprising the CDRL1 amino acid sequence of Seq ID No:37 (IMGT) or Seq ID No:40 (Kabat), the CDRL2 amino acid sequence of Seq ID No:38 (IMGT) or Seq ID No:41 (Kabat), and the CDRL3 amino acid sequence of Seq ID No:39 (IMGT) or Seq ID No:42 (Kabat). The light chain nucleic acid sequence of the $V_L$ domain is Seq ID No:44. The $V_H$ domain may be combined with any of the heavy chain constant region sequences described herein, e.g. Seq ID No:193, Seq ID No:195, Seq ID No:197, Seq ID No:199, Seq ID No:201, Seq ID No:203, Seq ID No:205, Seq ID No:340, Seq ID No:524, Seq ID No:526, Seq ID No:528, Seq ID No:530, Seq ID No:532 or Seq ID No:534. The $V_L$ domain may be combined with any of the light chain constant region sequences described herein, e.g. Seq ID Nos:207, 209, 211, 213, 215, 217, 219, 221, 223, 225, 227, 229, 231, 233, 235, 237, 536 and 538. A full length light chain amino acid sequence is Seq ID No:45 (light chain nucleic acid sequence Seq ID No:46).

1D05 HC mutant 4 has a heavy chain variable ($V_H$) region amino acid sequence of Seq ID No:342, comprising the CDRH1 amino acid sequence of Seq ID No:27 (IMGT) or Seq ID No:30 (Kabat), the CDRH2 amino acid sequence of Seq ID No:28 (IMGT) or Seq ID No:31 (Kabat), and the CDRH3 amino acid sequence of Seq ID No:29 (IMGT) or Seq ID No:32 (Kabat). 1D05 HC mutant 4 has a light chain variable region ($V_L$) amino acid sequence of Seq ID No:43, comprising the CDRL1 amino acid sequence of Seq ID No:37 (IMGT) or Seq ID No:40 (Kabat), the CDRL2 amino acid sequence of Seq ID No:38 (IMGT) or Seq ID No:41 (Kabat), and the CDRL3 amino acid sequence of Seq ID No:39 (IMGT) or Seq ID No:42 (Kabat). The light chain nucleic acid sequence of the $V_L$ domain is Seq ID No:44. The $V_H$ domain may be combined with any of the heavy chain constant region sequences described herein, e.g. Seq ID No:193, Seq ID No:195, Seq ID No:197, Seq ID No:199, Seq ID No:201, Seq ID No:203, Seq ID No:205, Seq ID No:340, Seq ID No:524, Seq ID No:526, Seq ID No:528, Seq ID No:530, Seq ID No:532 or Seq ID No:534. The $V_L$ domain may be combined with any of the light chain constant region sequences described herein, e.g. Seq ID Nos:207, 209, 211, 213, 215, 217, 219, 221, 223, 225, 227, 229, 231, 233, 235, 237, 536 and 538. A full length light chain amino acid sequence is Seq ID No:45 (light chain nucleic acid sequence Seq ID No:46).

1D05 LC mutant 1 has a heavy chain variable ($V_H$) region amino acid sequence of Seq ID No:33, comprising the CDRH1 amino acid sequence of Seq ID No:27 (IMGT) or Seq ID No:30 (Kabat), the CDRH2 amino acid sequence of Seq ID No:28 (IMGT) or Seq ID No:31 (Kabat), and the CDRH3 amino acid sequence of Seq ID No:29 (IMGT) or Seq ID No:32 (Kabat). The heavy chain nucleic acid sequence of the $V_H$ domain is Seq ID No:34. 1D05 LC mutant 1 has a light chain variable region ($V_L$) amino acid sequence of Seq ID No:50, comprising the CDRL1 amino acid sequence of Seq ID No:37 (IMGT) or Seq ID No:40 (Kabat), and the CDRL3 amino acid sequence of Seq ID No:39 (IMGT) or Seq ID No:42 (Kabat). The CDRL2 sequence of 1D05 LC Mutant 1 is as defined by the Kabat or IMGT systems from the $V_L$ sequence of Seq ID No:50. The $V_H$ domain may be combined with any of the heavy chain constant region sequences described herein, e.g. Seq ID No:193, Seq ID No:195, Seq ID No:197, Seq ID No:199, Seq ID No:201, Seq ID No:203, Seq ID No:205 or Seq ID No:340, Seq ID No:524, Seq ID No:526, Seq ID No:528, Seq ID No:530, Seq ID No:532 or Seq ID No:534. The $V_L$ domain may be combined with any of the light chain constant region sequences described herein, e.g. Seq ID Nos:207, 209, 211, 213, 215, 217, 219, 221, 223, 225, 227, 229, 231, 233, 235, 237, 536 and 538. A full length heavy chain amino acid sequence is Seq ID No:35 (heavy chain nucleic acid sequence Seq ID No:36).

1D05 LC mutant 2 has a heavy chain variable ($V_H$) region amino acid sequence of Seq ID No:33, comprising the CDRH1 amino acid sequence of Seq ID No:27 (IMGT) or Seq ID No:30 (Kabat), the CDRH2 amino acid sequence of Seq ID No:28 (IMGT) or Seq ID No:31 (Kabat), and the CDRH3 amino acid sequence of Seq ID No:29 (IMGT) or Seq ID No:32 (Kabat). The heavy chain nucleic acid sequence of the $V_H$ domain is Seq ID No:34. 1D05 LC mutant 2 has a light chain variable region ($V_L$) amino acid sequence of Seq ID No:51, comprising the CDRL1 amino acid sequence of Seq ID No:37 (IMGT) or Seq ID No:40 (Kabat), the CDRL2 amino acid sequence of Seq ID No:38 (IMGT) or Seq ID No:41 (Kabat), and the CDRL3 amino acid sequence of Seq ID No:39 (IMGT) or Seq ID No:42 (Kabat). The $V_H$ domain may be combined with any of the heavy chain constant region sequences described herein, e.g. Seq ID No:193, Seq ID No:195, Seq ID No:197, Seq ID No:199, Seq ID No:201, Seq ID No:203, Seq ID No:205, Seq ID No:340, Seq ID No:524, Seq ID No:526, Seq ID No:528, Seq ID No:530, Seq ID No:532 or Seq ID No:534. The $V_L$ domain may be combined with any of the light chain constant region sequences described herein, e.g. Seq ID Nos:207, 209, 211, 213, 215, 217, 219, 221, 223, 225, 227, 229, 231, 233, 235, 237, 536 and 538. A full length heavy chain amino acid sequence is Seq ID No:35 (heavy chain nucleic acid sequence Seq ID No:36).

1D05 LC mutant 3 has a heavy chain variable ($V_H$) region amino acid sequence of Seq ID No:33, comprising the CDRH1 amino acid sequence of Seq ID No:27 (IMGT) or Seq ID No:30 (Kabat), the CDRH2 amino acid sequence of Seq ID No:28 (IMGT) or Seq ID No:31 (Kabat), and the CDRH3 amino acid sequence of Seq ID No:29 (IMGT) or Seq ID No:32 (Kabat). The heavy chain nucleic acid sequence of the $V_H$ domain is Seq ID No:34. 1D05 LC mutant 3 has a light chain variable region ($V_L$) amino acid sequence of Seq ID No:298, comprising the CDRL1 amino acid sequence of Seq ID No:37 (IMGT) or Seq ID No:40 (Kabat), and the CDRL3 amino acid sequence of Seq ID No:39 (IMGT) or Seq ID No:42 (Kabat). The CDRL2 sequence of 1D05 LC Mutant 3 is as defined by the Kabat or IMGT systems from the $V_L$ sequence of Seq ID No:298. The light chain nucleic acid sequence of the $V_L$ domain is Seq ID No:44. The $V_H$ domain may be combined with any of the heavy chain constant region sequences described herein, e.g. Seq ID No:193, Seq ID No:195, Seq ID No:197, Seq ID No:199, Seq ID No:201, Seq ID No:203, Seq ID No:205 or Seq ID No:340, Seq ID No:524, Seq ID No:526, Seq ID No:528, Seq ID No:530, Seq ID No:532 or Seq ID No:534. The $V_L$ domain may be combined with any of the light chain constant region sequences described herein, e.g. Seq ID Nos:207, 209, 211, 213, 215, 217, 219, 221, 223, 225, 227, 229, 231, 233, 235, 237, 536 and 538. A full length heavy chain amino acid sequence is Seq ID No:35 (heavy chain nucleic acid sequence Seq ID No:36). A full length light chain amino acid sequence is Seq ID No:45 (light chain nucleic acid sequence Seq ID No:46).

411B08 has a heavy chain variable ($V_H$) region amino acid sequence of Seq ID No:58, comprising the CDRH1 amino acid sequence of Seq ID No:52 (IMGT) or Seq ID No:55 (Kabat), the CDRH2 amino acid sequence of Seq ID No:53 (IMGT) or Seq ID No:56 (Kabat), and the CDRH3 amino acid sequence of Seq ID No:54 (IMGT) or Seq ID No:57 (Kabat). The heavy chain nucleic acid sequence of the $V_H$ domain is Seq ID No:59. 411B08 has a light chain variable region ($V_L$) amino acid sequence of Seq ID No:68, comprising the CDRL1 amino acid sequence of Seq ID No:62 (IMGT) or Seq ID No:65 (Kabat), the CDRL2 amino acid sequence of Seq ID No:63 (IMGT) or Seq ID No:66 (Kabat), and the CDRL3 amino acid sequence of Seq ID No:64 (IMGT) or Seq ID No:67 (Kabat). The light chain nucleic acid sequence of the $V_L$ domain is Seq ID No:69. The $V_H$ domain may be combined with any of the heavy chain constant region sequences described herein, e.g. Seq ID No:193, Seq ID No:195, Seq ID No:197, Seq ID No:199, Seq ID No:201, Seq ID No:203, Seq ID No:205, Seq ID No:340, Seq ID No:524, Seq ID No:526, Seq ID No:528, Seq ID No:530, Seq ID No:532 or Seq ID No:534. The $V_L$ domain may be combined with any of the light chain constant region sequences described herein, e.g. Seq ID Nos:207, 209, 211, 213, 215, 217, 219, 221, 223, 225, 227, 229, 231, 233, 235, 237, 536 and 538. A full length heavy chain amino acid sequence is Seq ID No:60 (heavy chain nucleic acid sequence Seq ID No:61). A full length light chain amino acid sequence is Seq ID No:70 (light chain nucleic acid sequence Seq ID No:71).

411C04 has a heavy chain variable ($V_H$) region amino acid sequence of Seq ID No:78, comprising the CDRH1 amino acid sequence of Seq ID No:72 (IMGT) or Seq ID No:75 (Kabat), the CDRH2 amino acid sequence of Seq ID No:73 (IMGT) or Seq ID No:76 (Kabat), and the CDRH3 amino acid sequence of Seq ID No:74 (IMGT) or Seq ID No:77 (Kabat). The heavy chain nucleic acid sequence of the $V_H$ domain is Seq ID No:79. 411C04 has a light chain variable region ($V_L$) amino acid sequence of Seq ID No:88, comprising the CDRL1 amino acid sequence of Seq ID No:82 (IMGT) or Seq ID No:85 (Kabat), the CDRL2 amino acid sequence of Seq ID No:83 (IMGT) or Seq ID No:86 (Kabat), and the CDRL3 amino acid sequence of Seq ID No:84 (IMGT) or Seq ID No:87 (Kabat). The light chain nucleic acid sequence of the $V_L$ domain is Seq ID No:89. The $V_H$ domain may be combined with any of the heavy chain constant region sequences described herein, e.g. Seq ID No:193, Seq ID No:195, Seq ID No:197, Seq ID No:199, Seq ID No:201, Seq ID No:203, Seq ID No:205, Seq ID No:340, Seq ID No:524, Seq ID No:526, Seq ID No:528, Seq ID No:530, Seq ID No:532 or Seq ID No:534. The $V_L$ domain may be combined with any of the light chain constant region sequences described herein, e.g. Seq ID Nos:207, 209, 211, 213, 215, 217, 219, 221, 223, 225, 227, 229, 231, 233, 235, 237, 536 and 538. A full length heavy chain amino acid sequence is Seq ID No:80 (heavy chain nucleic acid sequence Seq ID No:81). A full length light chain amino acid sequence is Seq ID No:90 (light chain nucleic acid sequence Seq ID No:91).

411D07 has a heavy chain variable ($V_H$) region amino acid sequence of Seq ID No:98, comprising the CDRH1 amino acid sequence of Seq ID No:92 (IMGT) or Seq ID No:95 (Kabat), the CDRH2 amino acid sequence of Seq ID No:93 (IMGT) or Seq ID No:96 (Kabat), and the CDRH3 amino acid sequence of Seq ID No:94 (IMGT) or Seq ID No:97 (Kabat). The heavy chain nucleic acid sequence of the $V_H$ domain is Seq ID No:99. 411D07 has a light chain variable region ($V_L$) amino acid sequence of Seq ID No:108, comprising the CDRL1 amino acid sequence of Seq ID No:102 (IMGT) or Seq ID No:105 (Kabat), the CDRL2 amino acid sequence of Seq ID No:103 (IMGT) or Seq ID No:106 (Kabat), and the CDRL3 amino acid sequence of Seq ID No:104 (IMGT) or Seq ID No:107 (Kabat). The light chain nucleic acid sequence of the $V_L$ domain is Seq ID No:109. The $V_H$ domain may be combined with any of the heavy chain constant region sequences described herein, e.g. Seq ID No:193, Seq ID No:195, Seq ID No:197, Seq ID No:199, Seq ID No:201, Seq ID No:203, Seq ID No:205, Seq ID No:340, Seq ID No:524, Seq ID No:526, Seq ID No:528, Seq ID No:530, Seq ID No:532 or Seq ID No:534. The $V_L$ domain may be combined with any of the light chain constant region sequences described herein, e.g. Seq ID Nos:207, 209, 211, 213, 215, 217, 219, 221, 223, 225, 227, 229, 231, 233, 235, 237, 536 and 538. A full length heavy chain amino acid sequence is Seq ID No:100 (heavy chain nucleic acid sequence Seq ID No:101). A full length light chain amino acid sequence is Seq ID No: 110 (light chain nucleic acid sequence Seq ID No:111).

385F01 has a heavy chain variable ($V_H$) region amino acid sequence of Seq ID No:118, comprising the CDRH1 amino acid sequence of Seq ID No:112 (IMGT) or Seq ID No:115 (Kabat), the CDRH2 amino acid sequence of Seq ID No:113 (IMGT) or Seq ID No:116 (Kabat), and the CDRH3 amino acid sequence of Seq ID No:114 (IMGT) or Seq ID No:117 (Kabat). The heavy chain nucleic acid sequence of the $V_H$ domain is Seq ID No:119. 385F01 has a light chain variable region ($V_L$) amino acid sequence of Seq ID No:128, comprising the CDRL1 amino acid sequence of Seq ID No:122 (IMGT) or Seq ID No:125 (Kabat), the CDRL2 amino acid sequence of Seq ID No:123 (IMGT) or Seq ID No:126 (Kabat), and the CDRL3 amino acid sequence of Seq ID No:124 (IMGT) or Seq ID No:127 (Kabat). The light chain nucleic acid sequence of the $V_L$ domain is Seq ID No:129. The $V_H$ domain may be combined with any of the heavy chain constant region sequences described herein, e.g. Seq ID No:193, Seq ID No:195, Seq ID No:197, Seq ID No:199, Seq ID No:201, Seq ID No:203, Seq ID No:205, Seq ID No:340, Seq ID No:524, Seq ID No:526, Seq ID No:528, Seq ID No:530, Seq ID No:532 or Seq ID No:534. The $V_L$ domain may be combined with any of the light chain constant region sequences described herein, e.g. Seq ID Nos:207, 209, 211, 213, 215, 217, 219, 221, 223, 225, 227, 229, 231, 233, 235, 237, 536 and 538. A full length heavy chain amino acid sequence is Seq ID No:120 (heavy chain nucleic acid sequence Seq ID No:121). A full length light chain amino acid sequence is Seq ID No:130 (light chain nucleic acid sequence Seq ID No:131).

386H03 has a heavy chain variable ($V_H$) region amino acid sequence of Seq ID No:158, comprising the CDRH1 amino acid sequence of Seq ID No:152 (IMGT) or Seq ID No:155 (Kabat), the CDRH2 amino acid sequence of Seq ID No:153 (IMGT) or Seq ID No:156 (Kabat), and the CDRH3 amino acid sequence of Seq ID No:154 (IMGT) or Seq ID No:157 (Kabat). The heavy chain nucleic acid sequence of the $V_H$ domain is Seq ID No:159. 386H03 has a light chain variable region ($V_L$) amino acid sequence of Seq ID No:168, comprising the CDRL1 amino acid sequence of Seq ID No:162 (IMGT) or Seq ID No:165 (Kabat), the CDRL2 amino acid sequence of Seq ID No:163 (IMGT) or Seq ID No:166 (Kabat), and the CDRL3 amino acid sequence of Seq ID No:164 (IMGT) or Seq ID No:167 (Kabat). The light chain nucleic acid sequence of the $V_L$ domain is Seq ID No:169. The $V_H$ domain may be combined with any of the heavy chain constant region sequences described herein, e.g. Seq ID No:193, Seq ID No:195, Seq ID No:197, Seq ID No:199, Seq ID No:201, Seq ID No:203, Seq ID No:205, Seq ID No:340, Seq ID No:524, Seq ID No:526, Seq ID No:528, Seq ID No:530, Seq ID No:532 or Seq ID No:534. The $V_L$ domain may be combined with any of the light chain constant region sequences described herein, e.g. Seq ID Nos:207, 209, 211, 213, 215, 217, 219, 221, 223, 225, 227, 229, 231, 233, 235, 237, 536 and 538. A full length heavy chain amino acid sequence is Seq ID No:160 (heavy chain nucleic acid sequence Seq ID No:161). A full length light chain amino acid sequence is Seq ID No:170 (light chain nucleic acid sequence Seq ID No:171).

389A03 has a heavy chain variable ($V_H$) region amino acid sequence of Seq ID No:178, comprising the CDRH1 amino acid sequence of Seq ID No:172 (IMGT) or Seq ID No:175 (Kabat), the CDRH2 amino acid sequence of Seq ID No:173 (IMGT) or Seq ID No:176 (Kabat), and the CDRH3 amino acid sequence of Seq ID No:174 (IMGT) or Seq ID No:177 (Kabat). The heavy chain nucleic acid sequence of the $V_H$ domain is Seq ID No:179. 389A03 has a light chain variable region ($V_L$) amino acid sequence of Seq ID No:188, comprising the CDRL1 amino acid sequence of Seq ID No:182 (IMGT) or Seq ID No:185 (Kabat), the CDRL2 amino acid sequence of Seq ID No:183 (IMGT) or Seq ID No:186 (Kabat), and the CDRL3 amino acid sequence of Seq ID No:184 (IMGT) or Seq ID No:187 (Kabat). The light chain nucleic acid sequence of the $V_L$ domain is Seq ID No:189. The $V_H$ domain may be combined with any of the heavy chain constant region sequences described herein, e.g. Seq ID No:193, Seq ID No:195, Seq ID No:197, Seq ID No:199, Seq ID No:201, Seq ID No:203, Seq ID No:205, Seq ID No:340, Seq ID No:524, Seq ID No:526, Seq ID No:528, Seq ID No:530, Seq ID No:532 or Seq ID No:534. The $V_L$ domain may be combined with any of the light chain constant region sequences described herein, e.g. Seq ID Nos:207, 209, 211, 213, 215, 217, 219, 221, 223, 225, 227, 229, 231, 233, 235, 237, 536 and 538. A full length heavy chain amino acid sequence is Seq ID No:180 (heavy chain nucleic acid sequence Seq ID No:181). A full length light chain amino acid sequence is Seq ID No:190 (light chain nucleic acid sequence Seq ID No:191).

413D08 has a heavy chain variable ($V_H$) region amino acid sequence of Seq ID No:138, comprising the CDRH1 amino acid sequence of Seq ID No:132 (IMGT) or Seq ID No:135 (Kabat), the CDRH2 amino acid sequence of Seq ID No:133 (IMGT) or Seq ID No:136 (Kabat), and the CDRH3 amino acid sequence of Seq ID No:134 (IMGT) or Seq ID No:137 (Kabat). The heavy chain nucleic acid sequence of the $V_H$ domain is Seq ID No:139. 413D08 has a light chain variable region ($V_L$) amino acid sequence of Seq ID No:148, comprising the CDRL1 amino acid sequence of Seq ID No:142 (IMGT) or Seq ID No:145 (Kabat), the CDRL2 amino acid sequence of Seq ID No:143 (IMGT) or Seq ID No:146 (Kabat), and the CDRL3 amino acid sequence of Seq ID No:144 (IMGT) or Seq ID No:147 (Kabat). The light chain nucleic acid sequence of the $V_L$ domain is Seq ID No:149. The $V_H$ domain may be combined with any of the heavy chain constant region sequences described herein, e.g. Seq ID No:193, Seq ID No:195, Seq ID No:197, Seq ID No:199, Seq ID No:201, Seq ID No:203, Seq ID No:205, Seq ID No:340, Seq ID No:524, Seq ID No:526, Seq ID No:528, Seq ID No:530, Seq ID No:532 or Seq ID No:534. The $V_L$ domain may be combined with any of the light chain constant region sequences described herein, e.g. Seq ID Nos:207, 209, 211, 213, 215, 217, 219, 221, 223, 225, 227, 229, 231, 233, 235, 237, 536 and 538. A full length heavy chain amino acid sequence is Seq ID No: 140 (heavy chain nucleic acid sequence Seq ID No:141). A full length light chain amino acid sequence is Seq ID No:150 (light chain nucleic acid sequence Seq ID No:151).

413G05 has a heavy chain variable ($V_H$) region amino acid sequence of Seq ID No:244, comprising the CDRH1 amino acid sequence of Seq ID No:238 (IMGT) or Seq ID No:241 (Kabat), the CDRH2 amino acid sequence of Seq ID No:239 (IMGT) or Seq ID No:242 (Kabat), and the CDRH3 amino acid sequence of Seq ID No:240 (IMGT) or Seq ID No:243 (Kabat). The heavy chain nucleic acid sequence of the $V_H$ domain is Seq ID No:245. 413G05 has a light chain variable region ($V_L$) amino acid sequence of Seq ID No:254, comprising the CDRL1 amino acid sequence of Seq ID No:248 (IMGT) or Seq ID No:251 (Kabat), the CDRL2 amino acid sequence of Seq ID No:249 (IMGT) or Seq ID No:252 (Kabat), and the CDRL3 amino acid sequence of Seq ID No:250 (IMGT) or Seq ID No:253 (Kabat). The light chain nucleic acid sequence of the $V_L$ domain is Seq ID No:255. The $V_H$ domain may be combined with any of the heavy chain constant region sequences described herein, e.g. Seq ID No:193, Seq ID No:195, Seq ID No:197, Seq ID No:199, Seq ID No:201, Seq ID No:203, Seq ID No:205, Seq ID No:340, Seq ID No:524, Seq ID No:526, Seq ID No:528, Seq ID No:530, Seq ID No:532 or Seq ID No:534. The $V_L$ domain may be combined with any of the light chain constant region sequences described herein, e.g. Seq ID Nos:207, 209, 211, 213, 215, 217, 219, 221, 223, 225, 227, 229, 231, 233, 235, 237, 536 and 538. A full length heavy chain amino acid sequence is Seq ID No:246 (heavy chain nucleic acid sequence Seq ID No:247). A full length light chain amino acid sequence is Seq ID No:256 (light chain nucleic acid sequence Seq ID No:257).

413F09 has a heavy chain variable ($V_H$) region amino acid sequence of Seq ID No:264, comprising the CDRH1 amino acid sequence of Seq ID No:258 (IMGT) or Seq ID No:261 (Kabat), the CDRH2 amino acid sequence of Seq ID No:259 (IMGT) or Seq ID No:262 (Kabat), and the CDRH3 amino acid sequence of Seq ID No:260 (IMGT) or Seq ID No:263 (Kabat). The heavy chain nucleic acid sequence of the $V_H$ domain is Seq ID No:265. 413F09 has a light chain variable region ($V_L$) amino acid sequence of Seq ID No:274, comprising the CDRL1 amino acid sequence of Seq ID No:268 (IMGT) or Seq ID No:271 (Kabat), the CDRL2 amino acid sequence of Seq ID No:269 (IMGT) or Seq ID No:272 (Kabat), and the CDRL3 amino acid sequence of Seq ID No:270 (IMGT) or Seq ID No:273 (Kabat). The light chain nucleic acid sequence of the $V_L$ domain is Seq ID No:275. The $V_H$ domain may be combined with any of the heavy chain constant region sequences described herein, e.g. Seq ID No:193, Seq ID No:195, Seq ID No:197, Seq ID No:199, Seq ID No:201, Seq ID No:203, Seq ID No:205, Seq ID No:340, Seq ID No:524, Seq ID No:526, Seq ID No:528, Seq ID No:530, Seq ID No:532 or Seq ID No:534. The $V_L$ domain may be combined with any of the light chain constant region sequences described herein, e.g. Seq ID Nos:207, 209, 211, 213, 215, 217, 219, 221, 223, 225, 227, 229, 231, 233, 235, 237, 536 and 538. A full length heavy chain amino acid sequence is Seq ID No:266 (heavy chain nucleic acid sequence Seq ID No:267). A full length light chain amino acid sequence is Seq ID No:276 (light chain nucleic acid sequence Seq ID No:277).

414B06 has a heavy chain variable ($V_H$) region amino acid sequence of Seq ID No:284, comprising the CDRH1 amino acid sequence of Seq ID No:278 (IMGT) or Seq ID No:281 (Kabat), the CDRH2 amino acid sequence of Seq ID No:279 (IMGT) or Seq ID No:282 (Kabat), and the CDRH3 amino acid sequence of Seq ID No:280 (IMGT) or Seq ID No:283 (Kabat). The heavy chain nucleic acid sequence of the $V_H$ domain is Seq ID No:285. 414B06 has a light chain variable region ($V_L$) amino acid sequence of Seq ID No:294, comprising the CDRL1 amino acid sequence of Seq ID No:288 (IMGT) or Seq ID No:291(Kabat), the CDRL2 amino acid sequence of Seq ID No:289 (IMGT) or Seq ID No:292 (Kabat), and the CDRL3 amino acid sequence of Seq ID No:290 (IMGT) or Seq ID No:293 (Kabat). The light chain nucleic acid sequence of the $V_L$ domain is Seq ID No:295. The $V_H$ domain may be combined with any of the heavy chain constant region sequences described herein, e.g. Seq ID No:193, Seq ID No:195, Seq ID No:197, Seq ID No:199, Seq ID No:201, Seq ID No:203, Seq ID No:205, Seq ID No:340, Seq ID No:524, Seq ID No:526, Seq ID No:528, Seq ID No:530, Seq ID No:532 or Seq ID No:534. The $V_L$ domain may be combined with any of the light chain constant region sequences described herein, e.g. Seq ID Nos:207, 209, 211, 213, 215, 217, 219, 221, 223, 225, 227, 229, 231, 233, 235, 237, 536 and 538. A full length heavy chain amino acid sequence is Seq ID No:286 (heavy chain nucleic acid sequence Seq ID No:287). A full length light chain amino acid sequence is Seq ID No:296 (light chain nucleic acid sequence Seq ID No:297).

416E01 has a heavy chain variable region ($V_H$) amino acid sequence of Seq ID No:349, comprising the CDRH1 amino acid sequence of Seq ID No:343 (IMGT) or Seq ID No:346 (Kabat), the CDRH2 amino acid sequence of Seq ID No:344 (IMGT) or Seq ID No:347 (Kabat), and the CDRH3 amino acid sequence of Seq ID No:345 (IMGT) or Seq ID No:348 (Kabat). The heavy chain nucleic acid sequence of the $V_H$ domain is Seq ID No:350. 416E01 has a light chain variable region ($V_L$) amino acid sequence of Seq ID No:359, comprising the CDRL1 amino acid sequence of Seq ID No:353 (IMGT) or Seq ID No:356 (Kabat), the CDRL2 amino acid sequence of Seq ID No:354 (IMGT) or Seq ID No:357 (Kabat), and the CDRL3 amino acid sequence of Seq ID No:355 (IMGT) or Seq ID No:358 (Kabat). The light chain nucleic acid sequence of the $V_L$ domain is Seq ID No:360. The $V_H$ domain may be combined with any of the heavy chain constant region sequences described herein, e.g. Seq ID No:193, Seq ID No:195, Seq ID No:197, Seq ID No:199, Seq ID No:201, Seq ID No:203, Seq ID No:205, Seq ID No:340, Seq ID No:524, Seq ID No:526, Seq ID No:528, Seq ID No:530, Seq ID No:532 or Seq ID No:534. The $V_L$ domain may be combined with any of the light chain constant region sequences described herein, e.g. Seq ID Nos:207, 209, 211, 213, 215, 217, 219, 221, 223, 225, 227, 229, 231, 233, 235, 237, 536 and 538. A full length heavy chain amino acid sequence is Seq ID No:351 (heavy chain nucleic acid sequence Seq ID No:352). A full length light chain amino acid sequence is Seq ID No:361 (light chain nucleic acid sequence Seq ID No:362).

Antibody-Drug Conjugates

Anti-ICOS antibodies can be used as carriers of cytotoxic agents, to target Tregs. As reported in Example 18, Tregs located in the tumour microenvironment (TME) strongly express ICOS. ICOS is more strongly expressed on intratumoural Tregs than on intratumoural Teffs or peripheral Tregs. Thus, anti-ICOS antibodies labelled with a toxic drug or pro-drug may preferentially target Tregs in the TME to deliver the toxic payload, selectively inhibiting those cells. Such targeting of cytotoxic agents provides an additional route to removing the immune suppressive effect of Tregs, thereby altering the Treg:Teff balance in favour of Teff activity and may be used as an alternative to, or in combination with, any one or more of the other therapeutic approaches discussed herein (e.g., Fc effector-mediated inhibition of Tregs, agonism of effector T cells).

Accordingly, the invention provides an anti-ICOS antibody that is conjugated to a cytotoxic drug or pro-drug. In the case of a pro-drug, the pro-drug is activatable in the TME or other target site of therapeutic activity to generate the cytotoxic agent. Activation may be in response to a trigger such as photoactivation, e.g., using near-infrared light to activate a photoabsorber conjugate [36]. Spatially-selective activation of a pro-drug further enhances the cytotoxic effect of the antibody-drug conjugate, combining with the high ICOS expression on intratumoural Tregs to provide a cytotoxic effect that is highly selective for these cells.

For use in an antibody-drug conjugate, the cytotoxic drug or pro-drug is preferably non-immunogenic and non-toxic (dormant or inactive) during circulation of the antibody-drug conjugate in the blood. Preferably the cytotoxic drug (or the pro-drug, when activated) is potent—e.g., two to four molecules of the drug may be sufficient to kill the target cell. A photoactivatable pro-drug is silicapthalocyanine dye (IRDye 700 DX), which induces lethal damage to the cell membrane after near-infrared light exposure. Cytotoxic drugs include anti-mitotic agents such as monomethyl auristatin E and microtubule inhibitors such as maytansine derivatives, e.g., mertansine, DM1, emtansine.

Conjugation of the drug (or pro-drug) to the antibody will usually be via a linker. The linker may be a cleavable linker, e.g., disulphide, hydrazone or peptide link. Cathepsin-cleavable linkers may be used, so that the drug is released by cathepsin in tumour cells. Alternatively, non-cleavable linkers can be used, e.g., thioether linkage. Additional attachment groups and/or spacers may also be included.

The antibody in the antibody-drug conjugate may be an antibody fragment, such as Fab'2 or other antigen-binding fragment as described herein, as the small size of such fragments may assist penetration to the tissue site (e.g., solid tumour).

An anti-ICOS antibody according to the present invention may be provided as an immunocytokine. Anti-ICOS antibodies may also be administered with immunocytokines in combination therapy. A number of examples of antibodies are described herein for use in combination therapy with anti-ICOS, and any of these (e.g., an anti-PD-L1 antibody) may be provided as immunocytokines for use in the present invention. An immunocytokine comprises an antibody molecule conjugated to a cytokine, such as IL-2. Anti-ICOS:IL-2 conjugates and anti-PD-L1:IL-2 conjugates are thus further aspects of the present invention.

An IL-2 cytokine may have activity at the high ($\alpha\beta\gamma$) affinity IL-2 receptor and/or the intermediate affinity ($\alpha\beta$) IL-2 receptor. IL-2 as used in an immunocytokine may be human wild type IL-2 or a variant IL-2 cytokine having one or more amino acid deletions, substitutions or additions, e.g., IL-2 having a 1 to 10 amino acid deletion at the N-terminus. Other IL-2 variants include mutations R38A or R38Q.

An example anti-PD-L1 immunocytokine comprises an immunoglobulin heavy chain and an immunoglobulin light chain, wherein the heavy chain comprises in N- to C-terminal direction:
a) A $V_H$ domain comprising CDRH1, CDRH2 and CDRH3; and
b) A heavy chain constant region;
and wherein the light chain comprises in N- to C-terminal direction:
c) A $V_L$ domain comprising CDRL1, CDRL2 and CDRL3;
d) A light chain constant region, ($C_L$);
e) Optionally, a linker, (L); and
f) An IL-2 cytokine;
wherein the $V_H$ domain and $V_L$ domain are comprised by an antigen-binding site that specifically binds to human PD-L1; and
wherein the immunocytokine comprises a $V_H$ domain which comprises a CDRH3 comprising the motif $X_1GSGX_2YGX_3X_4FD$ (SEQ ID NO: 609), wherein $X_1$, $X_2$ and $X_3$ are independently any amino acid, and $X_4$ is either present or absent, and if present, may be any amino acid.

The VH and VL domain may be the VH and VL domain of any anti-PD-L1 antibody mentioned herein, e.g., the 1D05 VH and VL domains.

The IL-2 may be human wild type or variant IL-2.

Vaccination

Anti-ICOS antibodies may be provided in vaccine compositions or co-administered with vaccines preparations. ICOS is involved in T follicular helper cell formation and the germinal centre reaction [37]. Agonist ICOS antibodies thus have potential clinical utility as molecular adjuvants to enhance vaccine efficacy. The antibodies may be used to increase protective efficacy of numerous vaccines, such as those against hepatitis B, malaria, HIV.

In the context of vaccination, the anti-ICOS antibody will generally be one that lacks Fc effector function, and thus does not mediate ADCC, CDC or ADCP. The antibody may be provided in a format lacking an Fc region, or having an effector null constant region. Optionally, an anti-ICOS antibody may have a heavy chain constant region that binds one or more types of Fc receptor but does not induce ADCC, CDC or ADCP activity, or that exhibits lower ADCC, CDC and ADCP activity compared with wild type human IgG1. Such a constant region may be unable to bind, or may bind with lower affinity, the particular Fc receptor(s) responsible for triggering ADCC, CDC or ADCP activity. Alternatively, where cellular effector functions are acceptable or desirable in the context of the vaccination, the anti-ICOS antibody may comprise a heavy chain constant region that is Fc effector function positive. Any of IgG1, IgG4 and IgG4.PE formats may for instance be used for anti-ICOS antibodies in vaccination regimens, and other examples of suitable isotypes and antibody constant regions are set out in more detail elsewhere herein.

Formulations and Administration

Antibodies may be monoclonal or polyclonal, but are preferably provided as monoclonal antibodies for therapeutic use. They may be provided as part of a mixture of other antibodies, optionally including antibodies of different binding specificity.

Antibodies according to the invention, and encoding nucleic acid, will usually be provided in isolated form. Thus, the antibodies, VH and/or VL domains, and nucleic acids may be provided purified from their natural environment or their production environment. Isolated antibodies and isolated nucleic acid will be free or substantially free of material with which they are naturally associated, such as other polypeptides or nucleic acids with which they are found in vivo, or the environment in which they are prepared (e.g., cell culture) when such preparation is by recombinant DNA technology in vitro. Optionally an isolated antibody or nucleic acid (1) is free of at least some other proteins with which it would normally be found, (2) is essentially free of other proteins from the same source, e.g., from the same species, (3) is expressed by a cell from a different species, (4) has been separated from at least about 50 percent of polynucleotides, lipids, carbohydrates, or other materials with which it is associated in nature, (5) is operably associated (by covalent or noncovalent interaction) with a polypeptide with which it is not associated in nature, or (6) does not occur in nature.

Antibodies or nucleic acids may be formulated with diluents or adjuvants and still for practical purposes be isolated—for example they may be mixed with carriers if used to coat microtitre plates for use in immunoassays, and may be mixed with pharmaceutically acceptable carriers or diluents when used in therapy. As described elsewhere herein, other active ingredients may also be included in therapeutic preparations. Antibodies may be glycosylated, either naturally in vivo or by systems of heterologous eukaryotic cells such as CHO cells, or they may be (for example if produced by expression in a prokaryotic cell) unglycosylated. The invention encompasses antibodies having a modified glycosylation pattern. In some applications, modification to remove undesirable glycosylation sites may be useful, or e.g., removal of a fucose moiety to increase ADCC function [38]. In other applications, modification of galactosylation can be made in order to modify CDC.

Typically, an isolated product constitutes at least about 5%, at least about 10%, at least about 25%, or at least about 50% of a given sample. An antibody may be substantially free from proteins or polypeptides or other contaminants that are found in its natural or production environment that would interfere with its therapeutic, diagnostic, prophylactic, research or other use.

An antibody may have been identified, separated and/or recovered from a component of its production environment (eg, naturally or recombinantly). The isolated antibody may be free of association with all other components from its production environment, eg, so that the antibody has been isolated to an FDA-approvable or approved standard. Contaminant components of its production environment, such as that resulting from recombinant transfected cells, are materials that would typically interfere with research, diagnostic or therapeutic uses for the antibody, and may include enzymes, hormones, and other proteinaceous or non-proteinaceous solutes. In some embodiments, the antibody will be purified: (1) to greater than 95% by weight of antibody as determined by, for example, the Lowry method, and in some embodiments, to greater than 99% by weight; (2) to a degree sufficient to obtain at least 15 residues of N-terminal or internal amino acid sequence by use of a spinning cup sequenator, or (3) to homogeneity by SDS-PAGE under non-reducing or reducing conditions using Coomassie blue or silver stain. Isolated antibody includes the antibody in situ within recombinant cells since at least one component of the antibody's natural environment will not be present. Ordinarily, however, an isolated antibody or its encoding nucleic acid will be prepared by at least one purification step.

The invention provides therapeutic compositions comprising the antibodies described herein. Therapeutic compositions comprising nucleic acid encoding such antibodies are also provided. Encoding nucleic acids are described in more detail elsewhere herein and include DNA and RNA, e.g., mRNA. In therapeutic methods described herein, use of nucleic acid encoding the antibody, and/or of cells containing such nucleic acid, may be used as alternatives (or in addition) to compositions comprising the antibody itself. Cells containing nucleic acid encoding the antibody, optionally wherein the nucleic acid is stably integrated into the genome, thus represent medicaments for therapeutic use in a patient. Nucleic acid encoding the anti-ICOS antibody may be introduced into human B lymphocytes, optionally B lymphocytes derived from the intended patient and modified ex vivo. Optionally, memory B cells are used. Administration of cells containing the encoding nucleic acid to the patient provides a reservoir of cells capable of expressing the anti-ICOS antibody, which may provide therapeutic benefit over a longer term compared with administration of isolated nucleic acid or isolated antibody.

Compositions may contain suitable carriers, excipients, and other agents that are incorporated into formulations to provide improved transfer, delivery, tolerance, and the like. A multitude of appropriate formulations can be found in the formulary known to all pharmaceutical chemists: Remington's Pharmaceutical Sciences, Mack Publishing Company, Easton, Pa. These formulations include, for example, powders, pastes, ointments, jellies, waxes, oils, lipids, lipid (cationic or anionic) containing vesicles (such as LIPO-FECTIN™), DNA conjugates, anhydrous absorption pastes, oil-in-water and water-in-oil emulsions, emulsions carbowax (polyethylene glycols of various molecular weights), semi-solid gels, and semi-solid mixtures containing carbowax. See also Powell et al. "Compendium of excipients for parenteral formulations" PDA (1998) J Pharm Sci Technol 52:238-311. Compositions may comprise the antibody or nucleic acid in combination with medical injection buffer and/or with adjuvant.

Antibodies, or their encoding nucleic acids, may be formulated for the desired route of administration to a patient, e.g., in liquid (optionally aqueous solution) for injection. Various delivery systems are known and can be used to administer the pharmaceutical composition of the invention. Methods of introduction include, but are not limited to, intradermal, intramuscular, intraperitoneal, intravenous, subcutaneous, intranasal, epidural, and oral routes. Formulating antibodies for subcutaneous administration typically requires concentrating them into a smaller volume compared with intravenous preparations. The high potency of antibodies according to the present invention may lend them to use at sufficiently low doses to make subcutaneous formulation practical, representing an advantage compared with less potent anti-ICOS antibodies.

The composition may be administered by any convenient route, for example by infusion or bolus injection, by absorption through epithelial or mucocutaneous linings (e.g., oral mucosa, rectal and intestinal mucosa, etc.) and may be administered together with other biologically active agents. Administration can be systemic or local.

The pharmaceutical composition can be also delivered in a vesicle, in particular a liposome (see Langer (1990) Science 249:1527-1533; Treat et al. (1989) in Liposomes in the Therapy of Infectious Disease and Cancer, Lopez Berestein and Fidler (eds.), Liss, New York, pp. 353-365; Lopez-Berestein, ibid., pp. 317-327; see generally ibid.).

In certain situations, the pharmaceutical composition can be delivered in a controlled release system. In one embodiment, a pump may be used (see Langer, supra; Sefton (1987) CRC Crit. Ref. Biomed. Eng. 14:201). In another embodiment, polymeric materials can be used; see, Medical Applications of Controlled Release, Langer and Wise (eds.), CRC Pres., Boca Raton, Fla. (1974). In yet another embodiment, a controlled release system can be placed in proximity of the composition's target, thus requiring only a fraction of the systemic dose (see, e.g., Goodson, in Medical Applications of Controlled Release, supra, vol. 2, pp. 115-138, 1984).

The injectable preparations may include dosage forms for intravenous, subcutaneous, intracutaneous and intramuscular injections, drip infusions, etc. These injectable preparations may be prepared by methods publicly known. For example, the injectable preparations may be prepared, e.g., by dissolving, suspending or emulsifying the antibody or its salt described above in a sterile aqueous medium or an oily medium conventionally used for injections. As the aqueous medium for injections, there are, for example, physiological saline, an isotonic solution containing glucose and other auxiliary agents, etc., which may be used in combination with an appropriate solubilizing agent such as an alcohol (e.g., ethanol), a polyalcohol (e.g., propylene glycol, polyethylene glycol), a nonionic surfactant [e.g., polysorbate 80, HCO-50 (polyoxyethylene (50 mol) adduct of hydrogenated castor oil)], etc. As the oily medium, there are employed, e.g., sesame oil, soybean oil, etc., which may be used in combination with a solubilizing agent such as benzyl benzoate, benzyl alcohol, etc. The injection thus prepared can be filled in an appropriate ampoule. A pharmaceutical composition of the present invention can be delivered subcutaneously or intravenously with a standard needle and syringe. It is envisaged that treatment will not be restricted to use in the clinic. Therefore, subcutaneous injection using a needle-free device is also advantageous. With respect to subcutaneous delivery, a pen delivery device readily has applications in delivering a pharmaceutical composition of the present invention. Such a pen delivery device can be reusable or disposable. A reusable pen delivery device generally utilizes a replaceable cartridge that contains a pharmaceutical composition. Once all of the pharmaceutical composition within the cartridge has been administered and the cartridge is empty, the empty cartridge can readily be discarded and replaced with a new cartridge that contains the pharmaceutical composition. The pen delivery device can then be reused. In a disposable pen delivery device, there is no replaceable cartridge. Rather, the disposable pen delivery device comes prefilled with the pharmaceutical composition held in a reservoir within the device. Once the reservoir is emptied of the pharmaceutical composition, the entire device is discarded. Numerous reusable pen and autoinjector delivery devices have applications in the subcutaneous delivery of a pharmaceutical composition of the present invention. Examples include, but certainly are not limited to AUTOPEN™ (Owen Mumford, Inc., Woodstock, UK), DISETRONIC™ pen (Disetronic Medical Systems, Burghdorf, Switzerland), HUMALOG MIX 75/25™ pen, HUMALOG™ pen, HUMALIN 70/30™ pen (Eli Lilly and Co., Indianapolis, Ind.), NOVOPEN™I, II and III (Novo Nordisk, Copenhagen, Denmark), NOVOPEN JUNIOR™ (Novo Nordisk, Copenhagen, Denmark), BD™ pen (Becton Dickinson, Franklin Lakes, N.J.), OPTIPENT™, OPTIPEN PRO™, OPTIPEN STARLET™, and OPTICLIKT™ (Sanofi-Aventis, Frankfurt, Germany), to name only a few. Examples of disposable pen delivery devices having applications in subcutaneous delivery of a pharmaceutical composition of the present invention include, but certainly are not limited to the SOLOSTAR™ pen (Sanofi-Aventis), the FLEXPEN™ (Novo Nordisk), and the KWIKPEN™ (Eli Lilly).

Advantageously, the pharmaceutical compositions for oral or parenteral use described above are prepared into dosage forms in a unit dose suited to fit a dose of the active ingredients. Such dosage forms in a unit dose include, for example, tablets, pills, capsules, injections (ampoules), suppositories, etc. The amount of the aforesaid antibody contained is generally about 5 to about 500 mg per dosage form in a unit dose; especially in the form of injection, the aforesaid antibody may be contained in about 5 to about 100 mg and in about 10 to about 250 mg for the other dosage forms.

The antibody, nucleic acid, or composition comprising it, may be contained in a medical container such as a phial, syringe, IV container or an injection device. In an example, the antibody, nucleic acid or composition is in vitro, and may be in a sterile container. In an example, a kit is provided comprising the antibody, packaging and instructions for use in a therapeutic method as described herein.

One aspect of the invention is a composition comprising an antibody or nucleic acid of the invention and one or more pharmaceutically acceptable excipients, examples of which are listed above. "Pharmaceutically acceptable" refers to approved or approvable by a regulatory agency of the USA Federal or a state government or listed in the U.S. Pharmacopeia or other generally recognized pharmacopeia for use in animals, including humans. A pharmaceutically acceptable carrier, excipient, or adjuvant can be administered to a patient, together with an agent, e.g., any antibody or antibody chain described herein, and does not destroy the pharmacological activity thereof and is nontoxic when administered in doses sufficient to deliver a therapeutic amount of the agent.

In some embodiments, an anti-ICOS antibody will be the sole active ingredient in a composition according to the present invention. Thus, a composition may consist of the antibody or it may consist of the antibody with one or more pharmaceutically acceptable excipients. However, compositions according to the present invention optionally include one or more additional active ingredients. Detailed description of agents with which the anti-ICOS antibodies may be combined is provided elsewhere herein. Optionally, compositions contain multiple antibodies (or encoding nucleic acids) in a combined preparation, e.g., a single formulation comprising the anti-ICOS antibody and one or more other antibodies. Other therapeutic agents that it may be desirable to administer with antibodies or nucleic acids according to the present invention include analgaesic agents. Any such agent or combination of agents may be administered in combination with, or provided in compositions with antibodies or nucleic acids according to the present invention, whether as a combined or separate preparation. The antibody or nucleic acid according to the present invention may be administered separately and sequentially, or concurrently and optionally as a combined preparation, with another therapeutic agent or agents such as those mentioned.

Anti-ICOS antibodies for use in a particular therapeutic indication may be combined with the accepted standard of care. Thus, for anti-cancer treatment, the antibody therapy may be employed in a treatment regimen that also includes chemotherapy, surgery and/or radiation therapy for example. Radiotherapy may be single dose or in fractionated doses, either delivered to affected tissues directly or to the whole body.

Multiple compositions can be administered separately or simultaneously. Separate administration refers to the two compositions being administered at different times, e.g. at least 10, 20, 30, or 10-60 minutes apart, or 1, 2, 3, 4, 5, 6, 7, 8, 9, 10, 12 hours apart. One can also administer compositions at 24 hours apart, or even longer apart. Alternatively, two or more compositions can be administered simultaneously, e.g. less than 10 or less than 5 minutes apart. Compositions administered simultaneously can, in some aspects, be administered as a mixture, with or without similar or different time release mechanism for each of the components.

Antibodies, and their encoding nucleic acids, can be used as therapeutic agents. Patients herein are generally mammals, typically humans. An antibody or nucleic acid may be administered to a mammal, e.g., by any route of administration mentioned herein.

Administration is normally in a "therapeutically effective amount", this being an amount that produces the desired effect for which it is administered, sufficient to show benefit to a patient. The exact amount will depend on the purpose of the treatment, and will be ascertainable by one skilled in the art using known techniques (see, for example, Lloyd (1999) The Art, Science and Technology of Pharmaceutical Compounding). Prescription of treatment, e.g. decisions on dosage etc, is within the responsibility of general practitioners and other medical doctors and may depend on the severity of the symptoms and/or progression of a disease being treated. A therapeutically effective amount or suitable dose of antibody or nucleic acid can be determined by comparing its in vitro activity and in vivo activity in an animal model. Methods for extrapolation of effective dosages in mice and other test animals to humans are known.

As indicated by the in vivo studies described in the Examples herein, anti-ICOS antibody may be effective at a range of doses. Pharmacodynamic studies are reported in Example 24.

Anti-ICOS antibodies may be administered in an amount in one of the following ranges per dose:

about 10 µg/kg body weight to about 100 mg/kg body weight, about 50 µg/kg body weight to about 5 mg/kg body weight, about 100 µg/kg body weight to about 10 mg/kg body weight, about 100 µg/kg body weight to about 20 mg/kg body weight, about 0.5 mg/kg body weight to about 20 mg/kg body weight, or about 5 mg/kg body weight or lower, for example less than 4, less than 3, less than 2, or less than 1 mg/kg of the antibody.

An optimal therapeutic dose may be between 0.1 and 0.5 mg/kg in a human, for example about 0.1 mg/kg, 0.15 mg/kg, 0.2 mg/kg, 0.25 mg/kg, 0.3 mg/kg, 0.35 mg/kg, 0.4 mg/kg, 0.45 mg/kg or 0.5 mg/kg. For fixed dosing in adult humans, a suitable dose may be between 8 and 50 mg, or between 8 and 25 mg, e.g., 15 mg or 20 mg.

In methods of treatment described herein, one or more doses may be administered. In some cases, a single dose may be effective to achieve a long-term benefit. Thus, the method may comprise administering a single dose of the antibody, its encoding nucleic acid, or the composition. Alternatively, multiple doses may be administered, usually sequentially and separated by a period of days, weeks or months. Anti-ICOS antibody may be repeatedly administered to a patient at intervals of 4 to 6 weeks, e.g., every 4 weeks, every 5 weeks, or every 6 weeks. Optionally, the anti-ICOS antibody may be administered to a patient once a month, or less frequently, e.g., every two months or every three months. Accordingly, a method of treating a patient may comprise administering a single dose of the anti-ICOS antibody to the patient, and not repeating the administration for at least one month, at least two months, at least three months, and optionally not repeating the administration for at least 12 months.

As discussed in Example 11c, comparable therapeutic effects may be obtained using either one or multiple doses of anti-ICOS antibody, which may be a result of a single dose of antibody being effective to reset the tumour microenvironment. Physicians can tailor the administration regimen of the anti-ICOS antibody to the disease and the patient undergoing therapy, taking into account the disease status and any other therapeutic agents or therapeutic measures (e.g., surgery, radiotherapy etc) with which the anti-ICOS antibody is being combined. In some embodiments, an effective dose of an anti-ICOS antibody is administered more frequently than once a month, such as, for example, once every three weeks, once every two weeks, or once every week. Treatment with anti-ICOS antibody may include multiple doses administered over a period of at least a month, at least six months, or at least a year.

As used herein, the terms "treat," "treatment," "treating," or "amelioration" refer to therapeutic treatments, wherein the object is to reverse, alleviate, ameliorate, inhibit, slow down or stop the progression or severity of a condition associated with a disease or disorder. The term "treating" includes reducing or alleviating at least one adverse effect or symptom of a condition, disease or disorder. Treatment is generally "effective" if one or more symptoms or clinical markers are reduced. Alternatively, treatment is "effective" if the progression of a disease is reduced or halted. That is, "treatment" includes not just the improvement of symptoms or markers, but also a cessation of, or at least slowing of, progress or worsening of symptoms compared to what would be expected in the absence of treatment. Beneficial or desired clinical results include, but are not limited to, alleviation of one or more symptom(s), diminishment of extent of disease, stabilised (i.e., not worsening) state of disease, delay or slowing of disease progression, amelioration or palliation of the disease state, remission (whether partial or total), and/or decreased mortality, whether detectable or undetectable. The term "treatment" of a disease also includes providing relief from the symptoms or side-effects of the disease (including palliative treatment). For treatment to be effective a complete cure is not contemplated. The method can in certain aspects include cure as well. In the context of the invention, treatment may be preventative treatment.

T Cell Therapy

WO2011/097477 described use of anti-ICOS antibodies for generating and expanding T cells, by contacting a population of T cells with a first agent that provides a primary activation signal (e.g., an anti-CD3 antibody) and a second agent that activates ICOS (e.g., an anti-ICOS antibody), optionally in the presence of a Th17 polarising agent such as IL-1β, IL-6, neutralising anti-IFNγ and/or anti-IL-4. Anti-ICOS antibodies described herein may be used in such methods to provide T cell populations. Populations of cultured expanded T cells having therapeutic activity (e.g., anti-tumour activity) may be generated. As described in WO2011/097477, such T cells may be used therapeutically in methods of treating patients by immunotherapy.

Morphological Assay for Anti-ICOS Antibodies as Therapeutic Candidates

It was observed that when candidate therapeutic anti-ICOS antibodies were coupled to a solid surface and brought into contact with ICOS-expressing T cells, they were able to induce morphological change in the cells. On addition of ICOS+ T cells to wells that were internally coated with anti-ICOS antibodies, cells were seen to change from their initial rounded shape, adopting a spindle-shape, spreading and adhering to the antibody-coated surface. This morphological change was not observed with control antibody. Moreover, the effect was found to be dose-dependent, with faster and/or more pronounced shape change occurring as the concentration of antibody on the surface increased. The shape change provides a surrogate indicator of T cell binding to ICOS, and/or of agonism by anti-ICOS antibody. The assay may be used to identify an antibody that promotes multimerisation of ICOS on the T cell surface. Such antibodies represent therapeutic candidate agonist antibodies. Conveniently, the visual indicator provided by this assay is a simple method of screening antibodies or cells, particularly in large numbers. The assay may be automated to run in a high-throughput system.

Accordingly, one aspect of the invention is an assay for selecting an antibody that binds ICOS, optionally for selecting an ICOS agonist antibody, the assay comprising:

providing an array of antibodies immobilised (attached or adhered) to a substrate in a test well;

adding ICOS-expressing cells (e.g., activated primary T cells, or MJ cells) to the test well;

observing morphology of the cells;

detecting shape change in the cells from rounded to flattened against the substrate within the well; wherein the shape change indicates that the antibody is an antibody that binds ICOS, optionally an ICOS agonist antibody, and selecting the antibody from the test well.

The assay may be run with multiple test wells, each containing a different antibody for testing, optionally in parallel, e.g., in a 96 well plate format. The substrate is preferably an inner surface of the well. Thus, a two-dimensional surface is provided against which flattening of the cells may be observed. For example, the bottom and/or wall of a well may be coated with antibody. Tethering of antibody to the substrate may be via a constant region of the antibody.

A negative control may be included, such an antibody known not to bind ICOS, preferably an antibody that does not bind an antigen on the surface of the ICOS-expressing cells to be used. The assay may comprise quantifying the degree of morphological change and, where multiple antibodies are tested, selecting an antibody that induces greater morphological change than one or more other test antibodies.

Selection of antibody may comprise expressing nucleic acid encoding the antibody present in the test well of interest, or expressing an antibody comprising the CDRs or antigen binding domain of that antibody. The antibody may optionally be reformatted, for example to provide an antibody comprising the antigen binding domain of the selected antibody, e.g., an antibody fragment, or an antibody comprising a different constant region. A selected antibody is preferably provided with a human IgG1 constant region or other constant region as described herein. A selected antibody may further be formulated in a composition comprising one or more additional ingredients—suitable pharmaceutical formations are discussed elsewhere herein.

CLAUSES

Embodiments of the invention are set out in the following numbered clauses, which are part of the description.

Clause 1. An isolated antibody that binds the extracellular domain of human and/or mouse ICOS, wherein the antibody comprises a VH domain comprising an amino acid sequence having at least 95% sequence identity to the STIM003 VH domain SEQ ID NO: 408 and a VL domain comprising an amino acid sequence having at least 95% sequence identity to the STIM003 VL domain SEQ ID NO: 415.

Clause 2. An antibody according to clause 1, wherein the VH domain comprises a set of heavy chain complementarity determining regions (HCDRs) HCDR1, HCDR2 and HCDR3, wherein
HCDR1 is the STIM003 HCDR1 having amino acid sequence SEQ ID NO: 405,
HCDR2 is the STIM003 HCDR2 having amino acid sequence SEQ ID NO: 406,
HCDR3 is the STIM003 HCDR3 having amino acid sequence SEQ ID NO: 407.

Clause 3. An antibody according to clause 1 or clause 2, wherein the VL domain comprises a set of light chain complementarity determining regions (LCDRs) LCDR1, LCDR2 and LCDR3, wherein
LCDR1 is the STIM003 LCDR1 having amino acid sequence SEQ ID NO: 412,
LCDR2 is the STIM003 LCDR2 having amino acid sequence SEQ ID NO: 413,
LCDR3 is the STIM003 LCDR3 having amino acid sequence SEQ ID NO: 414.

Clause 4. An antibody according to clause 1, wherein the VH domain amino acid sequence is SEQ ID NO: 408 and/or wherein the VL domain amino acid sequence is SEQ ID NO: 415.

Clause 5. An isolated antibody that binds the extracellular domain of human and/or mouse ICOS, comprising
an antibody VH domain comprising complementarity determining regions (CDRs) HCDR1, HCDR2 and HCDR3, and
an antibody VL domain comprising complementarity determining regions LCDR1, LCDR2 and LCDR3, wherein
HCDR1 is the HCDR1 of STIM001, STIM002, STIM002-B, STIM003, STIM004, STIM005, STIM006, STIM007, STIM008 or STIM009, or comprises that HCDR1 with 1, 2, 3, 4 or 5 amino acid alterations,
HCDR2 is the HCDR2 of STIM001, STIM002, STIM002-B, STIM003, STIM004, STIM005, STIM006, STIM007, STIM008 or STIM009, or comprises that HCDR2 with 1, 2, 3, 4 or 5 amino acid alterations, and/or
HCDR3 is the HCDR3 of STIM001, STIM002, STIM002-B, STIM003, STIM004, STIM005, STIM006, STIM007, STIM008 or STIM009 or comprises that HCDR3 with 1, 2, 3, 4 or 5 amino acid alterations.

Clause 6. An antibody according to clause 5, wherein the antibody heavy chain CDRs are those of STIM001, STIM002, STIM002-B, STIM003, STIM004, STIM005, STIM006, STIM007, STIM008 or STIM009 or comprise the STIM001, STIM002, STIM002-B, STIM003, STIM004, STIM005, STIM006, STIM007, STIM008 or STIM009 heavy chain CDRs with 1, 2, 3, 4 or 5 amino acid alterations.

Clause 7. An antibody according to clause 6, wherein the antibody VH domain has the heavy chain CDRs of STIM003.

Clause 8. An isolated antibody that binds the extracellular domain of human and/or mouse ICOS, comprising
an antibody VH domain comprising complementarity determining regions HCDR1, HCDR2 and HCDR3, and
an antibody VL domain comprising complementarity determining regions LCDR1, LCDR2 and LCDR3,
wherein LCDR1 is the LCDR1 of STIM001, STIM002, STIM002-B, STIM003, STIM004 STIM005, STIM006, STIM007, STIM008 or STIM009, or comprises that LCDR1 with 1, 2, 3, 4 or 5 amino acid alterations,
LCDR2 is the LCDR2 of STIM001, STIM002, STIM002-B, STIM003, STIM004, STIM005, STIM006, STIM007, STIM008 or STIM009, or comprises that LCDR2 with 1, 2, 3, 4 or 5 amino acid alterations, and/or
LCDR3 is the LCDR3 of STIM001, STIM002, STIM002-B, STIM003, STIM004, STIM005, STIM006, STIM007, STIM008 or STIM009 or comprises that LCDR3 with 1, 2, 3, 4 or 5 amino acid alterations.

Clause 9. An antibody according to any of clauses 5 to 8, wherein the antibody light chain CDRs are those of STIM001, STIM002, STIM002-B, STIM003, STIM004, STIM005, STIM006, STIM007, STIM008 or STIM009, or comprise the STIM001, STIM002, STIM002-B, STIM003, STIM004, STIM005, STIM006, STIM007, STIM008 or STIM009 light chain CDRs with 1, 2, 3, 4 or 5 amino acid alterations.

Clause 10. An antibody according to clause 9, wherein the antibody VL domain has the light chain CDRs of STIM003.

Clause 11. An antibody according to any of clauses 5 to 10, comprising VH and/or VL domain framework regions of human germline gene segment sequences.

Clause 12. An antibody according to any of clauses 5 to 11, comprising a VH domain which
(i) is derived from recombination of a human heavy chain V gene segment, a human heavy chain D gene segment and a human heavy chain J gene segment, wherein
the V segment is IGHV1-18 (e.g., V1-18*01), IGVH3-20 (e.g. V3-20*d01), IGVH3-11 (e.g, V3-11*01) or IGVH2-5 (e.g., V2-5*10);
the D gene segment is IGHD6-19 (e.g., IGHD6-19*01), IGHD3-10 (e.g., IGHD3-10*01) or IGHD3-9 (e.g., IGHD3-9*01); and/or
the J gene segment is IGHJ6 (e.g., IGHJ6*02), IGHJ4 (e.g., IGHJ4*02) or IGHJ3 (e.g., IGHJ3*02), or
(ii) comprises framework regions FR1, FR2, FR3 and FR4, wherein
FR1 aligns with human germline V gene segment IGHV1-18 (e.g., V1-18*01), IGVH3-20 (e.g. V3-20*d01), IGVH3-11 (e.g, V3-11*01) or IGVH2-5 (e.g., V2-5*10), optionally with 1, 2, 3, 4 or 5 amino acid alterations,
FR2 aligns with human germline V gene segment IGHV1-18 (e.g., V1-18*01), IGVH3-20 (e.g. V3-20*d01), IGVH3-

11 (e.g, V3-11*01) or IGVH2-5 (e.g., V2-5*10), optionally with 1, 2, 3, 4 or 5 amino acid alterations, FR3 aligns with human germline V gene segment IGHV1-18 (e.g., V1-18*01), IGVH3-20 (e.g. V3-20*d01), IGVH3-11 (e.g, V3-11*01) or IGVH2-5 (e.g., V2-5*10), optionally with 1, 2, 3, 4 or 5 amino acid alterations, and/or FR4 aligns with human germline J gene segment IGJH6 (e.g., JH6*02), IGJH4 (e.g., JH4*02) or IGJH3 (e.g., JH3*02), optionally with 1, 2, 3, 4 or 5 amino acid alterations.

Clause 13. An antibody according to any of clauses 5 to 12, comprising an antibody VL domain which (i) is derived from recombination of a human light chain V gene segment and a human light chain J gene segment, wherein the V segment is IGKV2-28 (e.g., IGKV2-28*01), IGKV3-20 (e.g., IGKV3-20*01), IGKV1D-39 (e.g., IGKV1D-39*01) or IGKV3-11 (e.g., IGKV3-11*01), and/or the J gene segment is IGKJ4 (e.g., IGKJ4*01), IGKJ2 (e.g., IGKJ2*04), IGLJ3 (e.g., IGKJ3*01) or IGKJ1 (e.g., IGKJ1*01); or (ii) comprises framework regions FR1, FR2, FR3 and FR4, wherein FR1 aligns with human germline V gene segment IGKV2-28 (e.g., IGKV2-28*01), IGKV3-20 (e.g., IGKV3-20*01), IGKV1D-39 (e.g., IGKV1D-39*01) or IGKV3-11 (e.g., IGKV3-11*01), optionally with 1, 2, 3, 4 or 5 amino acid alterations, FR2 aligns with human germline V gene segment IGKV2-28 (e.g., IGKV2-28*01), IGKV3-20 (e.g., IGKV3-20*01), IGKV1D-39 (e.g., IGKV1D-39*01) or IGKV3-11 (e.g., IGKV3-11*01), optionally with 1, 2, 3, 4 or 5 amino acid alterations, FR3 aligns with human germline V gene segment IGKV2-28 (e.g., IGKV2-28*01), IGKV3-20 (e.g., IGKV3-20*01), IGKV1D-39 (e.g., IGKV1D-39*01) or IGKV3-11 (e.g., IGKV3-11*01), optionally with 1, 2, 3, 4 or 5 amino acid alterations, and/or FR4 aligns with human germline J gene segment IGKJ4 (e.g., IGKJ4*01), IGKJ2 (e.g., IGKJ2*04), IGKJ3 (e.g., IGKJ3*01) or IGKJ1 (e.g., IGKJ1*01), optionally with 1, 2, 3, 4 or 5 amino acid alterations.

Clause 14. An antibody according to any of clauses 5 to 13, comprising an antibody VH domain which is the VH domain of STIM001, STIM002, STIM002-B, STIM003, STIM004, STIM005, STIM006, STIM007, STIM008 or STIM009, or which has an amino acid sequence at least 90% identical to the antibody VH domain sequence of STIM001, STIM002, STIM002-B, STIM003, STIM004, STIM005, STIM006, STIM007, STIM008 or STIM009.

Clause 15. An antibody according to any of clauses 5 to 14, comprising an antibody VL domain which is the VL domain of STIM001, STIM002, STIM002-B, STIM003, STIM004, STIM005, STIM006, STIM007, STIM008 or STIM009, or which has an amino acid sequence at least 90% identical to the antibody VL domain sequence of STIM001, STIM002, STIM002-B, STIM003, STIM004, STIM005, STIM006, STIM007, STIM008 or STIM009.

Clause 16. An antibody according to clause 15, comprising an antibody VH domain which is selected from the VH domain of STIM001, STIM002, STIM002-B, STIM003, STIM004, STIM005, STIM006, STIM007, STIM008 or STIM009, or which has an amino acid sequence at least 90% identical to the antibody VH domain sequence of STIM001, STIM002, STIM002-B, STIM003, STIM004, STIM005, STIM006, STIM007, STIM008 or STIM009, and an antibody VL domain which is the VL domain of said selected antibody, or which has an amino acid sequence at least 90% identical to the antibody VL domain sequence of said selected antibody.

Clause 17. An antibody according to clause 16, comprising the STIM003 VH domain and the STIM003 VL domain.

Clause 18. An antibody according to any of the preceding clauses, comprising an antibody constant region.

Clause 19. An antibody according to clause 18, wherein the constant region comprises a human heavy and/or light chain constant region.

Clause 20. An antibody according to clause 18 or clause 19, wherein the constant region is Fc effector positive.

Clause 21. An antibody according to clause 20, comprising an Fc region that has enhanced ADCC, ADCP and/or CDC function compared with a native human Fc region.

Clause 22. An antibody according to any of clauses 18 to 21, wherein the antibody is an IgG1.

Clause 23. An antibody according to clause 21 or clause 22, wherein the antibody is afucosylated.

Clause 24. An antibody according to any of the preceding clauses which is conjugated to a cytotoxic drug or pro-drug.

Clause 25. An antibody according to any of the preceding clauses, which is a multispecific antibody.

Clause 26. An isolated antibody that binds the extracellular domain of human and mouse ICOS with an affinity ($K_D$) of less than 50 nM as determined by surface plasmon resonance.

Clause 27. An antibody according to clause 26, wherein the antibody binds the extracellular domain of human and mouse ICOS with an affinity ($K_D$) of less than 5 nM as determined by surface plasmon resonance.

Clause 28. An antibody according to clause 26 or clause 27, wherein the $K_D$ of binding the extracellular domain of human ICOS is within 10-fold of the $K_D$ of binding the extracellular domain of mouse ICOS.

Clause 29. A composition comprising an isolated antibody according to any of the preceding clauses and a pharmaceutically acceptable excipient.

Clause 30. A composition comprising isolated nucleic acid encoding an antibody according to any of clauses 1 to 28 and a pharmaceutically acceptable excipient.

Clause 31. A method of modulating the balance of regulatory T cells (Tregs) to effector T cells (Teffs) to increase Teff response in a patient, comprising administering an antibody according to any of clauses 1 to 28 or composition according to clause 29 to the patient.

Clause 32. A method of treating a disease or condition amenable to therapy by depleting regulatory T cells (Tregs) and/or increasing effector T cell (Teff) response in a patient, the method comprising administering an antibody according to any of clauses 1 to 28 or a composition according to clause 29 to the patient.

Clause 33. An antibody according to any of clauses 1 to 28, or a composition according to clause 29, for use in a method of treatment of the human body by therapy.

Clause 34. An antibody or composition for use according to clause 33, for use in modulating the balance of regulatory T cells (Tregs) to effector T cells (Teffs) to increase effector T cell response in a patient.

Clause 35. An antibody or composition for use according to clause 33, for use in treating a disease or condition amenable to therapy by depleting regulatory T cells (Tregs) and/or increasing effector T cell (Teff) response in a patient.

Clause 36. A method according to clause 32, or an antibody or a composition for use according to clause 35, wherein the disease is a cancer or a solid tumour.

Clause 37. An antibody according to any of clauses 1 to 28 or a composition according to clause 29, for use in a method of treating cancer in a human patient.

Clause 38. A method of treating cancer in a human patient, comprising administering an antibody according to any of clauses 1 to 28 or a composition according to clause 29 to the patient.

Clause 39. A method or an antibody or composition for use according to any of clauses 36 to 38, wherein the cancer is renal cell cancer, head and neck cancer, melanoma, non small cell lung cancer or diffuse large B-cell lymphoma.

Clause 40. A method or an antibody or composition for use according to any of clauses 31 to 39, wherein the method comprises administering the antibody and another therapeutic agent and/or radiation therapy to the patient.

Clause 41. A method or an antibody or composition for use according to clause 40, wherein the therapeutic agent is an anti-PD-L1 antibody.

Clause 42. A method or an antibody or composition for use according to clause 41, wherein the anti-PD-L1 antibody comprises a VH domain having amino acid sequence SEQ ID NO: 299 and a VL domain having amino acid sequence SEQ ID NO: 300.

Clause 43. A method or an antibody or composition for use according to clause 41 or clause 42, wherein the therapeutic agent is an anti-PD-L1 IL-2 immunocytokine.

Clause 44. A method or an antibody or composition for use according to clause 43, wherein the anti-PD-L1 antibody is an immunocytokine comprising human wild type or variant IL-2.

Clause 45. A method or an antibody or composition for use according to clause 44, wherein the anti-ICOS antibody and the anti-PDL1 antibody are each able to mediate ADCC, ADCP and/or CDC.

Clause 46. A method or an antibody or composition for use according to any of clauses 41 to 45, wherein the anti-ICOS antibody is a human IgG1 antibody and the anti-PDL1 antibody is a human IgG1 antibody.

Clause 47. A method or an antibody or composition for use according to clause 40, wherein the therapeutic agent is an anti-PD-1 antibody.

Clause 48. A method or an antibody or composition for use according to clause 40, wherein the other therapeutic agent is IL-2.

Clause 49. A method or an antibody or composition for use according to any of clauses 40 to 48, wherein the method comprises administering the anti-ICOS antibody after administering the other therapeutic agent and/or radiation therapy.

Clause 50. A method or an antibody or composition for use according to any of clauses 31 to 49, wherein
the anti-ICOS antibody is conjugated to a pro-drug, and wherein
the method or use comprises
administering the anti-ICOS antibody to a patient and
selectively activating the pro-drug at a target tissue site.

Clause 51. A method or an antibody or composition for use according to clause 50, wherein the patient has a solid tumour and the method comprises selectively activating the pro-drug in the tumour.

Clause 52. A method or an antibody or composition for use according to clause 50 or clause 51, comprising selectively activating the pro-drug through photoactivation.

Clause 53. Combination of anti-ICOS human IgG1 antibody and anti-PDL1 human IgG1 antibody for use in a method of treating cancer in a patient.

Clause 54. A method of treating cancer in a patient, comprising administering an anti-ICOS human IgG1 antibody and an anti-PD-L1 human IgG1 antibody to the patient.

Clause 55. Anti-ICOS antibody for use in a method of treating cancer in a patient, the method comprising administering the anti-ICOS antibody and the anti-PD-L1 antibody to the patient, wherein a single dose of the anti-ICOS antibody is administered.

Clause 56. Anti-ICOS antibody for use according to clause 55, wherein the anti-ICOS antibody is a human IgG1 antibody and the anti-PD-L1 antibody is a human IgG1 antibody.

Clause 57. Combination according to clause 53, method according to clause 54 or anti-ICOS antibody for use according to clause 55 or clause 56, wherein the cancer is renal cell cancer, head and neck cancer, melanoma, non small cell lung cancer or diffuse large B-cell lymphoma.

Clause 58. A method or an antibody, composition or combination for use according to any of clauses 41 to 46 or 53 to 54, the method comprising administering the anti-ICOS antibody and the anti-PD-L1 antibody to the patient, wherein a single dose of the anti-ICOS antibody is administered.

Clause 59. A method or an antibody, composition or combination for use according to clause 58, wherein the method comprises administering a single dose of the anti-ICOS antibody followed by multiple doses of the anti-PD-L1 antibody.

Clause 60. A method or an antibody, composition or combination for use according to any of clauses 41 to 46 or 53 to 54, wherein the anti-ICOS antibody and the anti-PDL1 antibody are provided in separate compositions for administration.

Clause 61. A method or an antibody, composition or combination for use according to any of clauses 41 to 46 or 53 to 60, wherein the anti-ICOS antibody and/or the anti-PD-L1 antibody comprises a human IgG1 constant region comprising amino acid sequence SEQ ID NO: 340.

Clause 62. Anti-ICOS antibody for use in a method of treating a patient, the method comprising administering the anti-ICOS antibody to a patient who has an increased level of ICOS-positive regulatory T cells following treatment with another therapeutic agent.

Clause 63. A method of treating a patient, the method comprising administering an anti-ICOS antibody to a patient who has an increased level of ICOS-positive regulatory T cells following treatment with another therapeutic agent.

Clause 64. An anti-ICOS antibody for use according to clause 62, or a method according to clause 63, wherein the method comprises administering a therapeutic agent to the patient, determining that the patient has an increased level of ICOS-positive regulatory T cells following the treatment with said agent, and administering an anti-ICOS antibody to the patient to reduce the level of regulatory T cells.

Clause 65. An anti-ICOS antibody for use or a method according to any of clauses 62 to 64, wherein the therapeutic agent is IL-2 or an immunomodulatory antibody (e.g., anti-PDL-1, anti-PD-1 or anti-CTLA-4).

Clause 66. An anti-ICOS antibody for use or a method according to any of clauses 62 to 65, wherein the method comprises treating a tumour, e.g., melanoma, such as metastatic melanoma.

Clause 67. Anti-ICOS antibody for use in a method of treating cancer in a patient by in vivo vaccination of the patient against their cancer cells, the method comprising treating the patient with a therapy that causes immunological cell death of the cancer cells, resulting in presentation of antigen to antigen-specific effector T cells, and administering an anti-ICOS antibody to the patient, wherein the anti-ICOS antibody enhances the antigen-specific effector T cell response.

Clause 68. A method of treating cancer in a patient by in vivo vaccination of the patient against their cancer cells, the method comprising treating the patient with a therapy that causes immunological cell death of the cancer cells, resulting in presentation of antigen to antigen-specific effector T cells, and administering an anti-ICOS antibody to the patient, wherein the anti-ICOS antibody enhances the antigen-specific effector T cell response.

Clause 69. A method of treating cancer in a patient by in vivo vaccination of the patient against their cancer cells, the method comprising administering an anti-ICOS antibody to the patient, wherein the patient is one who has been previously treated with a therapy that causes immunological cell death of the cancer cells, resulting in presentation of antigen to antigen-specific effector T cells, and wherein the anti-ICOS antibody enhances the antigen-specific effector T cell response.

Clause 70. Anti-ICOS antibody for use or a method according to any of clauses 67 to 69, wherein the therapy that causes immunological cell death is radiation of the cancer cells, administration of a chemotherapeutic agent and/or administration of an antibody directed to a tumour-associated antigen.

Clause 71. Anti-ICOS antibody for use or a method according to clause 70, wherein the chemotherapeutic agent is oxaliplatin.

Clause 72. Anti-ICOS antibody for use or a method according to clause 70, wherein the tumour-associated antigen is HER2 or CD20.

Clause 73. Anti-ICOS antibody for use in a method of treating a cancer in a patient, wherein the cancer is or has been characterised as being positive for expression of ICOS ligand and/or FOXP3.

Clause 74. A method of treating a cancer in a patient, wherein the cancer is or has been characterised as being positive for expression of ICOS ligand and/or FOXP3, the method comprising administering an anti-ICOS antibody to the patient.

Clause 75. Anti-ICOS antibody for use according to clause 73, or a method according to clause 74, wherein the method comprises:

testing a sample from a patient to determine that the cancer expresses ICOS ligand and/or FOXP3;

selecting the patient for treatment with the anti-ICOS antibody; and administering the anti-ICOS antibody to the patient.

Clause 76. Anti-ICOS antibody for use according to clause 73, or a method according to clause 74, wherein the method comprises administering an anti-ICOS antibody to a patient from whom a test sample has indicated that the cancer is positive for expression of ICOS ligand and/or FOXP3.

Clause 77. Anti-ICOS antibody for use or a method according to clause 75 or clause 76, wherein the sample is biopsy sample of a solid tumour.

Clause 78. Anti-ICOS antibody for use in a method of treating a cancer in a patient, wherein the cancer is or has been characterised as being refractory to treatment with an immunooncology drug, e.g., anti-CTLA-4 antibody, anti-PD1 antibody, anti-PD-L1 antibody, anti-CD137 antibody or anti-GITR antibody.

Clause 79. A method of treating a cancer in a patient, wherein the cancer is or has been characterised as being refractory to treatment with an immunooncology drug, e.g., anti-CTLA-4 antibody, anti-PD1 antibody, anti-PD-L1 antibody, anti-CD137 antibody or anti-GITR antibody, the method comprising administering an anti-ICOS antibody to the patient.

Clause 80. Anti-ICOS antibody for use according to clause 78 or a method according to clause 79, wherein the method comprises:

treating the patient with the immunooncology drug;

determining that the cancer is not responsive to the drug;

selecting the patient for treatment with the anti-ICOS antibody; and administering the anti-ICOS antibody to the patient.

Clause 81. Anti-ICOS antibody for use according to clause 78, or a method according to clause 79, wherein the method comprises administering an anti-ICOS antibody to a patient whose cancer was not responsive to prior treatment with the immunooncology drug.

Clause 82. Anti-ICOS antibody for use or a method according to any of clauses 73 to 81, wherein the cancer is a tumour derived from cells that have acquired ability to express ICOS ligand.

Clause 83. Anti-ICOS antibody for use or a method according to clause 82, wherein the cancer is melanoma.

Clause 84. Anti-ICOS antibody for use or a method according to any of clauses 73 to 81, wherein the cancer is derived from an antigen-presenting cell, such as a B lymphocyte (e.g., B cell lymphoma, such as diffuse large B cell lymphoma) or a T lymphocyte.

Clause 85. Anti-ICOS antibody for use or a method according to any of clauses 73 to 81, wherein the cancer is resistant to treatment with an anti-CD20 antibody.

Clause 86. Anti-ICOS antibody for use or a method according to clause 85, wherein the cancer is B cell lymphoma.

Clause 87. Anti-ICOS antibody for use or a method according to clause 86, wherein the anti-CD20 antibody is rituximab.

Clause 88. Anti-ICOS antibody for use or a method according to any of clauses 85 to 87, wherein the method comprises treating the patient with the anti-CD20 antibody;

determining that the cancer is not responsive to the anti-CD20 antibody;

testing a sample from a patient to determine that the cancer expresses ICOS ligand;

selecting the patient for treatment with the anti-ICOS antibody; and administering the anti-ICOS antibody to the patient.

Clause 89. Anti-ICOS antibody for use or a method according to any of clauses 85 to 87, wherein the method comprises administering an anti-ICOS antibody to a patient whose cancer was not responsive to prior treatment with anti-CD20 antibody.

Clause 90. Anti-ICOS antibody for use or a method according to any of clauses 67 to 89, wherein the cancer is a solid tumour.

Clause 91. Anti-ICOS antibody for use or a method according to any of clauses 67 to 89, wherein the cancer is a haemotological liquid tumour.

Clause 92. Anti-ICOS antibody for use or a method according to clause 90 or 91, wherein the tumour is high in regulatory T cells.

Clause 93. Anti-ICOS antibody for use or a method according to any of clauses 53 to 92, wherein the anti-ICOS antibody is as defined in any of clauses 1 to 28 or is provided in a composition according to clause 29.

Clause 94. A transgenic non-human mammal having a genome comprising a human or humanised immunoglobulin locus encoding human variable region gene segments, wherein the mammal does not express ICOS.

Clause 95. A method of producing an antibody that binds the extracellular domain of human and non-human ICOS, comprising
(a) immunising a mammal according to clause 94 with human ICOS antigen;
(b) isolating antibodies generated by the mammal;
(c) testing the antibodies for ability to bind human ICOS and non-human ICOS; and
(d) selecting one or more antibodies that binds both human and non-human ICOS.

Clause 96. A method according to clause 95, comprising immunising the mammal with cells expressing human ICOS.

Clause 97. A method according to clause 95 or clause 96, comprising
(c) testing the antibodies for ability to bind human ICOS and non-human ICOS using surface plasmon resonance and determining binding affinities; and
(d) selecting one or more antibodies for which the $K_D$ of binding to human ICOS is less than 50 nM and the $K_D$ of binding to non-human ICOS is less than 500 nM.

Clause 98. A method according to clause 97, comprising
(d) selecting one or more antibodies for which the $K_D$ of binding to human ICOS is less than 10 nM and the $K_D$ of binding to non-human ICOS is less than 100 nM.

Clause 99. A method according to any of clauses 95 to 98, comprising
(c) testing the antibodies for ability to bind human ICOS and non-human ICOS using surface plasmon resonance and determining binding affinities; and
(d) selecting one or more antibodies for which the $K_D$ of binding to human ICOS is within 10-fold of the $K_D$ of binding to non-human ICOS.

Clause 100. A method according to clause 99, comprising
(d) selecting one or more antibodies for which the $K_D$ of binding to human ICOS is within 5-fold of the $K_D$ of binding to non-human ICOS.

Clause 101. A method according to any of clauses 95 to 100, comprising testing the antibodies for ability to bind non-human ICOS from the same species as the mammal.

Clause 102. A method according to any of clauses 95 to 101, comprising testing the antibodies for ability to bind non-human ICOS from a different species as the mammal.

Clause 103. A method according to any of clauses 95 to 102, wherein the mammal is a mouse or a rat.

Clause 104. A method according to any of clauses 95 to 103, wherein the non-human ICOS is mouse ICOS or rat ICOS.

Clause 105. A method according to any of clauses 95 to 104, wherein the human or humanised immunoglobulin locus comprises human variable region gene segments upstream of an endogenous constant region.

Clause 106. A method according to clause 105, comprising
(a) immunising a mammal according to clause 94 with human ICOS antigen, wherein the mammal is a mouse;
(b) isolating antibodies generated by the mouse;
(c) testing the antibodies for ability to bind human ICOS and mouse ICOS; and
(d) selecting one or more antibodies that binds both human and mouse ICOS.

Clause 107. A method according to any of clauses 95 to 106, comprising isolating nucleic acid encoding an antibody heavy chain variable domain and/or an antibody light chain variable domain.

Clause 108. A method according to any of clauses 95 to 107, wherein the mammal generates antibodies through recombination of human variable region gene segments and an endogenous constant region.

Clause 109. A method according to clause 107 or clause 108, comprising conjugating the nucleic acid encoding the heavy and/or light chain variable domain to a nucleotide sequence encoding a human heavy chain constant region and/or human light chain constant region respectively.

Clause 110. A method according to any of clauses 107 to 109, comprising introducing the nucleic acid into a host cell.

Clause 111. A method according to clause 110, comprising culturing the host cell under conditions for expression of the antibody, or of the antibody heavy and/or light chain variable domain.

Clause 112. An antibody, or antibody heavy and/or light chain variable domain, produced by the method according to any of clauses 95 to 111.

Clause 113. A method of selecting an antibody that binds ICOS, optionally for selecting an ICOS agonist antibody, the assay comprising:
providing an array of antibodies immobilised (attached or adhered) to a substrate in a test well;
adding ICOS-expressing cells (e.g., activated primary T cells, or MJ cells) to the test well;
observing morphology of the cells;
detecting shape change in the cells from rounded to flattened against the substrate within the well; wherein the shape change indicates that the antibody is an antibody that binds ICOS, optionally an ICOS agonist antibody;
selecting the antibody from the test well;
expressing nucleic acid encoding the CDRs of the selected antibody; and
formulating the antibody into a composition comprising one or more additional components.

Various further aspects and embodiments of the present invention will be apparent to those skilled in the art in view of the present disclosure. All documents mentioned in this specification, including published US counterparts of any patents or patent applications referred to, are incorporated herein by reference in their entirety.

EXPERIMENTAL EXAMPLES

The following Examples describe the generation, characterisation and performance of anti-ICOS antibodies. Antibodies were generated using the Kymouse™, a transgenic mouse platform capable of generating antibodies with human variable domains. Antibodies from the Kymouse™ have human variable domains, generated from human V (D) and J segments, and mouse constant domains. The endogenous mouse variable genes have been silenced and make up a very small portion of the repertoire (less than 0.5% of all heavy chain variable regions are of mouse origin). The Kymouse™ system is described in Lee et al 2014 [39], WO2011/004192, WO2011/158009 and WO2013/061098. This project employed the Kymouse™ HK strain, in which the heavy chain locus and light chain kappa locus are humanised.

ICOS knock-out Kymouse™ were immunised with either ICOS protein or a combination of alternating boosts of protein and cells expressing human and mouse ICOS.

Hits which bound to human ICOS were identified. The primary selection criteria for the screen was binding to human cell expressed ICOS (CHO cells) and binding to ICOS protein (HTRF). Binding to mouse ICOS protein and mouse cell expressed ICOS (CHO cells) was also assessed and taken into consideration when selecting primary screen hits. Using these criteria hits were progressed to a secondary screen. In the secondary screen hits were confirmed by determining binding to human and mouse ICOS expressed on CHO cells by flow cytometry.

From a large number of antibodies screened, a small panel were identified which bind to human/cynomolgus and mouse ICOS as determined by surface plasmon resonance and flow cytometry. These antibodies included STIM001, STIM002 and its variant STIM002-B, STIM003, STIM004 and STIM005. An additional four antibodies STIM006, STIM007, STIM008 and STIM009 were also selected, showing less cross-reactivity with mouse ICOS but demonstrating agonism of the human ICOS receptor. The data presented here indicate the ability of anti-ICOS antibodies to act as agonists of the ICOS receptor in an ICOS positive CD4+ cell line and also in a primary T cell-based assay, show cell-killing ability in an ADCC assay and an ability to promote an anti-tumour immune response in vivo.

Example 1: Generation of ICOS Knock-Out Mouse

An ICOS knock-out Kymouse™ line was generated by homologous recombination in Kymouse™ HK ES cells. In brief, a 3.5 kb targeting vector encoding a puromycin selection was targeted into ES cells. Successful targeting resulted in the replacement of a small region (72 bp) of the mouse ICOS locus with the puromycin cassette, disrupting the signal peptide/start codon of the gene. Positive ES clones were expanded and microinjected into mouse blastocysts and resulting chimaeras bred in order to ultimately generate animals homozygous for both the humanised heavy and kappa immunoglobulin loci and the modified, functionally-null, ICOS locus.

Example 2: Antigen and Cell-Line Preparation

Generation of Stably Transfected MEF and CHO-S Cells Expressing Human or Mouse ICOS Full length DNA sequences encoding human and mouse ICOS were codon optimised for mammalian expression, ordered as synthetic string DNA and cloned into an expression vector under the control of the CMV promoter and flanked by 3' and 5' piggyBac specific terminal repeat sequences facilitating stable integration into the cell genome (see [40]). The expression vector contained a puromycin selection cassette to facilitate stable cell line generation. For generation of human ICOS expressing and mouse ICOS expressing cell lines respectively, the human or mouse ICOS expression plasmid was co-transfected with a plasmid encoding piggyBac transposase into a mouse embryonic fibroblast (MEF) cell line and CHO-S cells using the FreeStyle Max transfection reagent (Invitrogen) according to manufacturer instructions. MEF cells were generated from embryos obtained from a 129S5 crossed to C57BL6 female mouse. Twenty four hours after transfection, the media was supplemented with puromycin and grown for at least two weeks to select stable cell lines. Cell culture medium was replaced every 3-4 days. Expression of human or mouse ICOS protein was assessed by flow cytometry using anti-human or anti-mouse ICOS-PE conjugated antibodies (eBioscience) respectively. Complete MEF media was made up of Dulbecco's Modified Eagle's Medium (Gibco) supplemented with 10% v/v fetal bovine serum (Gibco). Complete CHO-S media was made up of CD-CHO media supplemented with 8 mM Glutamax (Gibco). CHO-S cells are the CHO-3E7 cell line included with the pTT5 system available from the National Research Council of Canada, but other CHO cell lines could be employed.

Preparation of MEF Cells for Mouse Immunisations

Cell culture medium was removed and cells washed once with 1×PBS. Cells were treated for 5 minutes with trypsin to loosen cells from tissue culture surface. Cells were collected and the trypsin neutralized by the addition of complete media containing 10% v/v fetal bovine serum (FCS). Cells were then centrifuged at 300 g for 10 minutes and washed with 25 ml of 1×PBS. Cells were counted and resuspended at the appropriate concentration in 1×PBS.

Cloning and Expression of Recombinant Proteins

Synthetic DNA encoding the extracellular domains of human ICOS (NCBI ID: NP_036224.1), mouse ICOS (NCBI ID: NP_059508.2) and cynomolgus ICOS (GenBank ID: EHH55098.1) were cloned into either a pREP4 (Invitrogen) or a pTT5 (National Research Council Of Canada) expression plasmid using standard molecular biology techniques. The constructs also contained either a human Fc, a mouse Fc or a FLAG His peptide motif to aid purification and detection. These were added to the DNA constructs by overlap extension. All constructs were sequenced prior to expression to ensure their correct sequence composition.

Example 3: Immunisation

ICOS knock out HK Kymice™ (see Example 1), Kymouse™ wild type HK strain and Kymouse™ wild type HL strain were immunised according to the regimens shown in Table E3. Kymouse™ wild type HK and HL strains express wild type mouse ICOS. In the HK strain the immunoglobulin heavy chain locus and light chain kappa locus are humanised, and in the HL strain the immunoglobulin heavy chain locus and light chain lambda locus are humanised.

TABLE E3

Immunisation regimens for Kymouse™ strains

| Regime | Mouse | Prime | Boost 1 | Boost 2 | Boost 3 | Final Boost |
|---|---|---|---|---|---|---|
| KM103 | ICOS KO | mICOS Fc | hICOS MEF | mICOS Fc | hICOS MEF | mICOS Fc |
| KM103 | ICOS KO | mICOS Fc | hICOS Fc | mICOS Fc | hICOS Fc | N/A |
| KM111 | ICOS KO | mICOS Fc + hICOS Fc | mICOS MEF + hICOS MEF | mICOS Fc + hICOS Fc | mICOS MEF + hICOS MEF | mICOS Fc + hICOS Fc |
| KM111 | ICOS KO | hICOS Fc | hICOS MEF | hICOS Fc | hICOS MEF | hICOS Fc |
| KM111 | ICOS KO | mICOS Fc | mICOS MEF | mICOS Fc | mICOS MEF | mICOS Fc |

TABLE E3-continued

Immunisation regimens for Kymouse ™ strains

| Regime | Mouse | Prime | Boost 1 | Boost 2 | Boost 3 | Final Boost |
|---|---|---|---|---|---|---|
| KM111 | HK and HL | hICOS Fc | hICOS MEF | hICOS Fc | hICOS MEF | hICOS Fc |
| KM135 | ICOS KO | | mICOS Fc 1 prime and 6 boosts (RIMMS) | | | |
| KM135 | ICOS KO | | hICOS Fc 1 prime and 6 boosts (RIMMS) | | | |

Key to table:
mICOS Fc=mouse ICOS protein with human Fc
hICOS Fc=human ICOS protein with human Fc
mICOS MEF=mouse ICOS expressed on MEF cells
hICOS MEF=human ICOS expressed on MEF cells
mICOS Fc+hICOS Fc=mouse ICOS protein with human Fc+human ICOS protein with human Fc administered simultaneously
mICOS MEF+hICOS MEF=mouse ICOS expressed on MEF cells+human ICOS expressed on MEF cells administered simultaneously
ICOS KO=ICOS knockout HK Kymouse
HK and HL=wild type Kymouse HK and HL genotype
RIMMS is a modified sub-cutaneous immunisation procedure (rapid immunisation at multiple sites); modified after Kilpatrick et al. [41]). Immunisation regimens KM103 and KM111 were prime-rest-boost by intraperitoneal (i.p.) administration. Sigma Adjuvant System was used for all immunisations and rest intervals were usually between 2 and 3 weeks. Final boosts were administered by intravenously in absence of adjuvant.

Sera from serial or terminal blood samples were analysed for the presence of specific antibodies by flow cytometry and the titre data was used (where possible) to select mice to be used for B cell sorting.

Example 4: Comparison of Serum Titres Between ICOS KO and Wild Type Mice

Figure 1B:
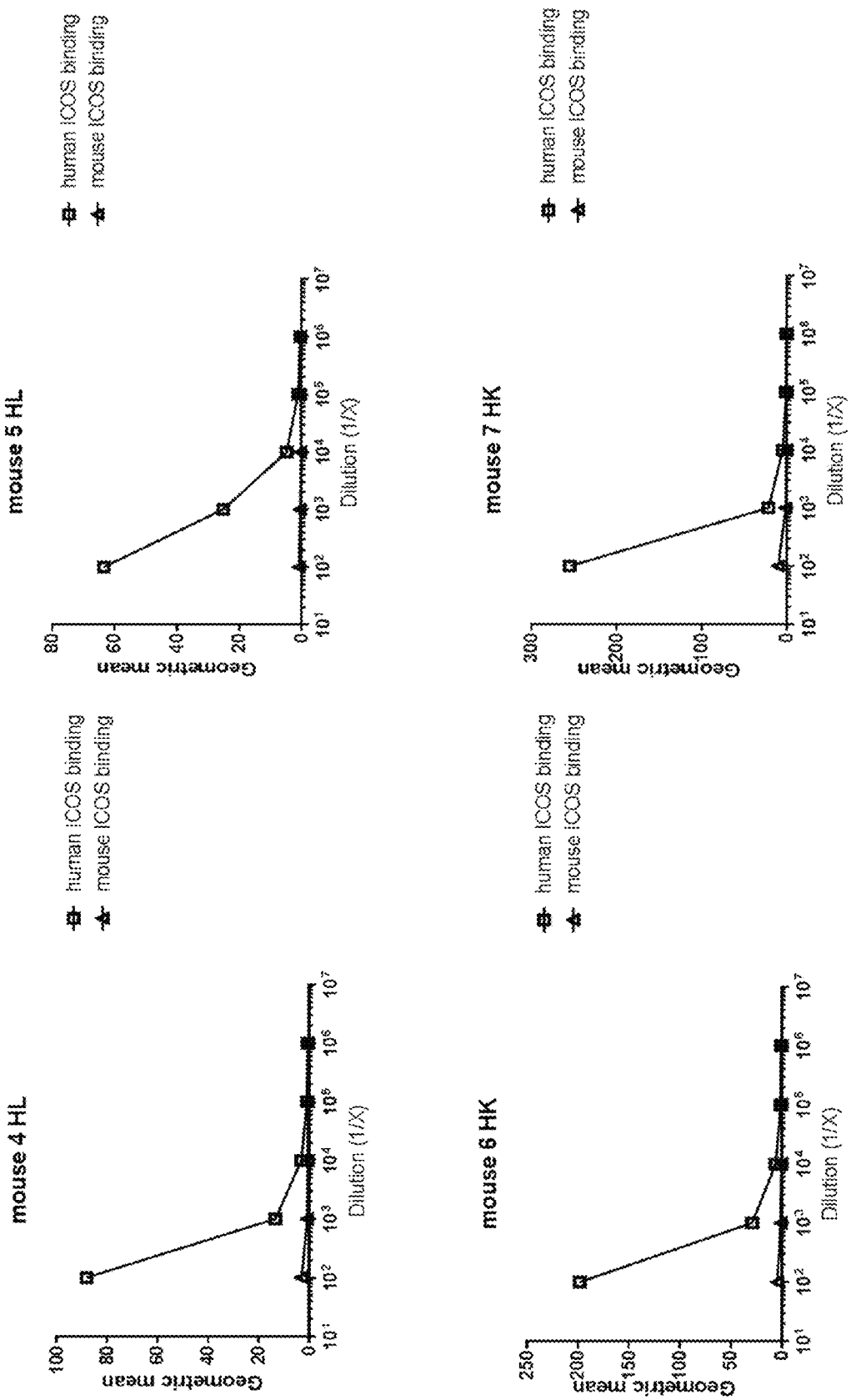

Serum titres of immunised ICOS KO and immunised wild type Kymouse were determined using flow cytometry. In ICOS KO mice, immunisation with human ICOS antigen induced a serum immunoglobulin response with Ig binding to both human and mouse ICOS expressed on CHO cells (FIG. 1a). Conversely, in the wild type Kymouse (expressing mouse ICOS), immunisation with the same human ICOS antigen produced sera that showed markedly reduced binding to mouse ICOS compared with binding of the same serum to human ICOS (FIG. 1b).
Method
CHO-S cells expressing human ICOS or mouse ICOS (see Example 2) or untransfected CHO-S cells (referred to as wild type (WT)), suspended in FACS buffer (PBS+1% w/v BSA+0.1% w/v sodium azide) were distributed to a 96-well, V-bottom plate (Greiner) at a density of $10^5$ cells per well. A titration of mouse serum was prepared, diluting samples in FACS buffer. 50 µL/well of this titration was then added to the cell plate. To determine the change in activity level due to immunisation, serum from each animal prior to immunisation was diluted to 1/100 in FACS buffer and 50 µL/well added to the cells. Cells were incubated at 4° C. for 1 hour. Cells were washed twice with 150 µL PBS, centrifuging after each wash step and aspirating supernatant (centrifuged at 300×g for 3 minutes). To detect antibody binding, APC goat-anti-mouse IgG (Jackson ImmunoResearch) was diluted 1/500 in FACS buffer and 50 µL was added to the cells. In some instances AF647 goat-anti-mouse IgG (Jackson ImmunoResearch) was used. Cells were incubated 1 hour at 4° C. in the dark, then washed twice with 150 µL PBS as above. To fix cells, 100 µL 2% v/v paraformaldehyde was added and cells incubated for 30 minutes at 4° C. Cells were then pelleted by centrifugation at 300×g and the plates resuspended in 50 µL of FACS buffer. Fluorescent signal intensity (geometric mean) was measured by flow cytometry using a BD FACS Array instrument.

Example 5: Sorting of Antigen-Specific B Cells by FACS

B-cells expressing anti-ICOS antibodies were recovered from immunised mice, using techniques substantially as described in Example 1 of WO2015/040401. In brief, splenocytes and/or lymph node cells isolated from the immunisation regimes were stained with an antibody cocktail containing markers for the selection of cells of interest (CD19), whereas unwanted cells were excluded from the final sorted population (IgM, IgD, 7AAD). CD19$^+$ B-cells were further labelled with fluorescently-tagged human ICOS ECD-Fc dimers and fluorescently-tagged mouse ICOS ECD-Fc to detect B-cells producing anti-ICOS antibodies. Fluorescent labelling of human and mouse ICOS was with AlexaFluor647 and AlexaFluor488, respectively—see Example 6. Cells binding human ICOS, or both human and mouse ICOS were selected. These cells were single cell sorted by FACS into lysis buffer. V-region sequences were recovered using RT-PCR and two further rounds of PCR, then bridged to mouse IgG1 constant region and expressed in HEK293 cells. Supernatants from HEK293 cells were screened for the presence of ICOS binding and functional antibodies. This method is hereafter referred to as BCT.

Example 6: Screening of Antibodies from BCT

HTRF Screening of BCT Supernatants for Binding to Recombinant Human and Mouse ICOS-Fc
Supernatants collected from BCT in Example 5 were screened for the ability of secreted antibodies to bind to human ICOS Fc and mouse ICOS Fc expressed as recombinant proteins. Binding of secreted antibodies to recombinant human and mouse ICOS were identified by HTRF® (Homogeneous Time-Resolved Fluorescence, Cisbio) assay format using FluoProbes®647H (Innova Biosciences) labelled ICOS (referred to herein as 647 hICOS or 647 mICOS for human ICOS and mouse ICOS labelled with FluoProbes®647H respectively). 5 µL BCT supernatant was transferred to a white 384-well, low-volume, non-binding surface polystyrene plate (Greiner). 5 µL of 20 nM 647 hICOS or 647 mICOS diluted in HTRF assay buffer was added to all wells. For human ICOS binding assay the reference antibody was diluted in BCT media (Gibco #A14351-01) to 120 nM and 5 µL added to plate. For negative control wells for human ICOS binding assay, 5 µL of mouse IgG1 (Sigma M9269 in some instances referred to as CM7) diluted to 120 nM in BCT media. In the case of mouse ICOS binding assay the reference antibody was diluted in BCT media (Gibco #A14351-01) to 120 nM and 5 µL added to plate. A rat IgG2b isotype control (R&D systems) was added to negative control wells (R&D Systems) diluted in BCT media to 120 nM and 5 µL added to plate. Binding of secreted antibodies to human ICOS was detected by addition of 10 µL of goat anti-mouse IgG (Southern Biotech) directly labelled with Europium cryptate (Cisbio) diluted 1/2000 in HTRF assay buffer. In the case of the mouse ICOS binding assay 5 µL of mouse anti-Rat IgG2B-UBLB (Southern Biotech) was added to positive and negative control wells, and 5 µL of HTRF assay buffer added to all other wells of plate. Then 5 µL of goat anti-mouse IgG (Southern Biotech) directly labelled with Europium cryptate (Cisbio) diluted 1/1000 in HTRF assay buffer was added to detect binding. The plate was left to incubate in the dark for 2 hours prior to reading time resolved fluorescence at 620 nm and 665 nm emission wavelengths, 100 flashes, using an EnVision plate reader (Perkin Elmer).

Data were analysed by calculating 665/620 ratio and percent effect for each sample according to equation 2 and equation 1 respectively.

For KM103 and KM11-B1, primary hits were selected based on greater than or equal to 5 percent effect for binding to human and mouse ICOS. For KM135 primary hits were selected based on greater than or equal to 10 percent effect for binding to human and mouse ICOS. For KM111-B2 primary hits were defined as greater than or equal to 4 percent effect for binding to human and greater than or equal to 3 percent effect for binding to mouse ICOS.

Equation 1: Calculation of Percentage Effect from Primary Screen Envision Cell Binding and HTRF
Using well ratio value (equation 3) or 665/620 nm ratio (see equation 2) (HTRF)

$$\text{Percent effect} = \frac{(\text{sample well} - \text{non-specific binding}) \times 100}{(\text{total binding} - \text{non-specific binding})}$$

Non-specific binding = values from wells containing isotype control mouse $IgG1$ Total Binding = values from wells containing reference antibody Equation 2: Calculation of 665/620 Ratio $$665/620 \text{ratio} = (\text{sample } 665/620 \text{ nm value}) \times 10{,}000$$

Equation 3: Calculation of 647/FITC Ratio
Data were first normalised for cell number by dividing mAb channel (647) by FITC (cell stain) channel to give "well ratio value":

$$\text{Well Ratio Value} = \frac{647 \text{ Channel}}{FITC \text{ Channel}}$$

Screening of BCT Supernatants for Binding to Cell-Expressed Human and Mouse ICOS Supernatants collected from BCT in Example 5 were screened for the ability of secreted antibodies to bind to human or mouse ICOS expressed on the surface of CHO-S cells. To determine CHO-S human and mouse ICOS binding, cells were plated in black-walled, clear-bottom tissue culture treated 384-well plates (Perkin Elmer) at $4 \times 10^4$/well in F12 media (Gibco) supplemented with 10% FBS (Gibco) and cultured overnight. Culture media was removed from 384-well assay plates. At least 50 µL of BCT supernatant or 50 µL reference antibody at 2 µg/mL in BCT media or isotype IgG1 control antibody (referred to in some instances as Cm7, Sigma M9269), at a final concentration of 2 µg/mL) diluted in BCT media were added to each well. Plates were incubated for 1 hour at 4° C. Supernatant was aspirated and 50 µL of goat anti-Mouse 647 (Jackson immunoresearch) at 5 µg/ml with vibrant green DNA stain (Life Technologies) diluted 1 in 500 in secondary antibody buffer (1×PBS+1% BSA+0.1% Sodium Azide) was added to detect antibody binding and visualise cells. Plates were incubated for 1 hr at 4 degrees. Supernatant was aspirated and 25 µL of 4% v/v paraformaldehyde added and plates were incubated for 15 minutes at room temperature. Plates were washed twice with 100 µL PBS and then the wash buffer was completely removed. Fluorescence intensity was measured using Envision plate reader (Perkin Elmer) measuring FITC (excitation 494 nm, emission 520 nm) and alexafluor 647 (excitation 650 nm, emission 668 nm). Assay signal was determined as described in equation 3 and percent effect as in equation 1. Total binding was defined using reference antibody at a final assay concentration of 2 µg/mL. Non-specific binding was defined using mouse IgG1 isotype control (Sigma) at a final assay concentration of 2 µg/mL. Criteria for hit selection were based on assay signal and percent effect.

For KM103, KM111-B1 and KM135, primary hits were selected based on greater than or equal to 10 percent effect. For KM111-132, primary hits were selected based on greater than or equal to 4 percent effect.

Summary of Primary Screening Results

TABLE E6

Summary of number of BCT supernatants screened from immunisations, and number of supernatants meeting primary screening selection criteria for binding to human and mouse ICOS.

| Experiment ID | Supernatants screened | Primary hits selected |
|---|---|---|
| KM103 | 1232 | 40 |
| KM111-B1 | 1056 | 198 |
| KM111-B2 | 1056 | 136 |
| KM135 | 704 | 31 |

FACS Screening for Binding to Cell Expressed Human and Mouse ICOS

BCT supernatants and HEK293 expressed antibodies from Example 5 were tested for ability to bind to CHO-S cells expressing human or mouse ICOS.

CHO-S cells expressing human or mouse ICOS (see Example 2), were diluted in FACS buffer (PBS 1% BSA 0.1% sodium azide) and were distributed to a 96-well, V-bottom plate (Greiner) at a density of $1 \times 10^5$ cells per well. Cells were washed with 150 µL PBS and centrifuged at 300 g for 3 minutes. For supernatant screening, supernatant was aspirated and 150 µL PBS added. This wash step was repeated. 30 µL BCT undiluted supernatant or 50 µL of reference antibody or control antibody diluted to 5 µg/ml in BCT media was added to the washed cells. Cells were incubated at 4° C. for 60 minutes. 150 µL FACS buffer was added and cells washed as described above. To detect antibody binding, 50 µL of goat anti-mouse APC (Jackson ImmunoResearch) diluted to 2 µg/ml in FACS buffer was added to cells. Cells were incubated 4° C. for 60 minutes. Cells were washed twice with 150 µL FACS buffer, centrifuging at 300 g for 3 minutes after each wash step and aspirating supernatant. Cells were fixed by addition of 25 μL 4% paraformaldehyde for 20 minutes at room temperature. Cells were washed once as above and resuspended in FACS buffer for analysis. APC signal intensity (geometric mean) was measured by flow cytometry using a BD FACS Array instrument. Data were plotted as geometric mean values without further calculation.

A small sub-set of antibodies were selected as meeting more stringent species cross-reactivity criteria in this further screening compared with the primary screening. In brief:

From KM103, 4 antibodies were selected by taking the average geomean of the hybrid control binding to hICOS, mICOS and WT CHO cells and identifying mouse and human binders that were >4 fold above. These 4 antibodies were designated STIM001, STIM002-B, STIM007 and STIM009.

From KM111-B1, 4 antibodies were selected by taking the average of geomean of the negative control (Armenian hamster: clone HTK888) binding to hICOS, mICOS and WT CHO cells and identifying mouse and human binders that were >10 fold above.

From KM111-132, 4 antibodies were selected by taking the average of geomean of the negative control (Armenian hamster: clone HTK888) binding to hICOS, mICOS and WT CHO cells and identifying mouse and human binders that were >4 fold above. These 4 antibodies included STIM003, STIM004 and STIM005.

From KM135, no cross-reactive antibodies were identified. Due to a technical failure of the FACS secondary screening method, screening was also carried out using SPR and HTRF, but no antibodies were found to meet the desired cross-reactivity level.

In conclusion, from the various multiple immunisation regimens described in Example 3, upward of 4000 BCT supernatants (from the ICOS KO mice only) were screened for binding to human ICOS and mouse ICOS, and a small panel of candidates, including STIM001, STIM002-B, STIM003, STIM004, STIM005, STIM007 and STIM009, were identified as having the most promising characteristics for further development. These were taken forward for more detailed characterisation.

Separately, two antibodies STIM006 and STIM008, which did not meet the species cross-reactivity criteria, were also chosen for further characterisation on the basis of their ability to bind human ICOS.

Example 7: Affinity Determination by Surface Plasmon Resonance (SPR)

Fab affinities of the ICOS leads were generated by SPR using the ProteOn XPR3 6 (BioRad). An anti-human IgG capture surface was created on a GLC biosensor chip by primary amine coupling, immobilising three anti-human IgG antibodies (Jackson Labs 109-005-008, 109-006-008 and 309-006-008). The human Fc tagged human ICOS (hICOS) and mouse ICOS (mICOS) were captured individually on the anti-human IgG surface and the purified Fabs were used as analytes at 5000 nM, 1000 nM, 200 nM, 40 nM and 8 nM, except for STIM003 which was used at 1000 nM, 200 nM, 40 nM, 8 nM and 2 nM. Binding sensorgrams were double referenced using a buffer injection (i.e. 0 nM), and the data was fitted to the 1:1 model inherent to the ProteOn XPR36 analysis software. The assay was run at 25° C. and using HBS-EP as running buffer.

TABLE E7-1

Affinity and kinetic data for selected antibodies as measured by SPR.

| Sample Ab | Ligand | ka | kd | KD (nM) |
|---|---|---|---|---|
| STIM006 | hICOS | 6.67E+05 | 9.20E−03 | 13.8 |
| STIM003 | hICOS | 6.56E+05 | 8.62E−04 | 1.3 |
| STIM001 | hICOS | 2.54E+04 | 1.12E−03 | 44.0 |
| STIM002 | hICOS | 3.20E+04 | 3.43E−02 | 1070.0 |
| STIM006 | mICOS | 1.57E+03 | 5.00E−04 | 318.0 |
| STIM003 | mICOS | 1.29E+06 | 5.03E−04 | 0.4 |
| STIM001 | mICOS | 5.66E+04 | 2.30E−02 | 407.0 |
| STIM002 | mICOS | weak | weak | weak |

In addition, a comparison was performed of antibody: antigen binding affinity at different pH values. As before, the dimeric human ICOS protein, presented as the extracellular domain of ICOS fused to a human Fc region, was captured on the anti-human Fc capture surface created using the 3 antibody cocktail, immobilised on the GLC biosensor chip by primary amine coupling. SPR analysis of recombinantly expressed anti-ICOS Fabs was carried out on the ProteOn XPR36 Array system (Biorad). The Fab fragments were used as analyte to generate binding sensorgrams, which were double referenced with a buffer injection (i.e., 0 nM). The subsequent referenced sensorgrams were fitted to the 1:1 model inherent to the ProteOn analysis software. Table E7-2 presents affinity and kinetic data for the antibodies, all run at 37° C. unless stated, using either HBS-EP at pH 7.4/7.6 or pH 5.5 as indicated. Data were fitted to the 1:1 model. Note that data for STIM002 fitted poorly to the 1:1 model at both pH 7.4 and 5.5—the affinity for this antibody may therefore be lower than indicated in the table.

TABLE E7-2

Relative affinity of STIM001, STIM002, STIM002-B and STIM003 Fabs against recombinant human ICOS, at 37° C. except where stated.

| Antibody (Fab) | pH | ka | kd | KD (nM) |
|---|---|---|---|---|
| STIM001 | 7.4 | 5.08E+04 | 3.23E−03 | 63.5 |
|  | 5.5 | 4.90E+04 | 3.58E−03 | 73.1 |
|  | 7.6 | 8.29E+04 | 3.54E−03 | 42.6 |
|  | 5.5 | 6.77E+04 | 5.41E−03 | 80.3 |
|  | 7.6 (25° C.) | 2.54E+04 | 1.12E−03 | 44 |
| STIM002 | 7.4 | 3.72E+04 | 8.31E−03 | 223 |
|  | 5.5 | 8.79E+04 | 3.67E−03 | 4.17 |
| STIM002-B | 7.4 | 8.28E+04 | 3.46E−03 | 41.8 |
|  | 5.5 | 8.64E+04 | 2.30E−03 | 26.6 |
| STIM003 | 7.4 | 1.49E+06 | 2.54E−03 | 1.71 |
|  | 5.5 | 1.55E+06 | 1.58E−03 | 1.02 |
|  | 7.6 | 1.87E+06 | 3.70E−03 | 1.98 |
|  | 5.5 | 1.71E+06 | 1.94E−03 | 1.15 |
|  | 7.6 (25° C.) | 6.65E+06 | 0.862E−03 | 1.31 |

Comparison of the affinity data at different pH values indicated that the antibodies retain binding to their target across a physiological pH range. The tumour microenvironment may be relatively acidic compared with blood, thus maintenance of affinity at low pH is a potential advantage in vivo to improve intra-tumoural T-reg depletion.

Example 8: Neutralisation of ICOS Ligand Binding to ICOS Receptor Assayed by HTRF Selected anti-ICOS antibodies were further assessed for their ability to neutralise ICOS ligand (B7-H2) binding to ICOS, using homogenous time resolved fluorescence (HTRF). Human IgG1 and human IgG4.PE (null-effector) isotypes of the mAbs were assessed in:

HTRF assay for neutralisation of human B7-H2 binding to human ICOS; and

HTRF assay for neutralisation of mouse B7-H2 binding to mouse ICOS.

Anti-ICOS antibody C398.4A (hamster IgG in each case) was included for comparison.

A number of antibodies were found to have high neutralising potency for human and/or mouse ICOS receptor-ligand binding, and the results indicated that some of these antibodies showed good cross-reactivity. The antibody isotype had no significant effect, differences in results between the IgG1 and IgG4.PE assays being within experimental error.

IgG1

In the human IgG1 assays, antibody C398.4A produced an IC50 of 1.2±0.30 nM for the neutralisation of human ICOS ligand and an IC50 of 0.14±0.01 nM for the neutralisation of mouse ICOS ligand.

IgG1 mAbs STIM001, STIM002, STIM003 and STIM005 produced similar IC50 to C398.4A using the human ICOS ligand neutralisation system and were also cross-reactive, neutralising binding of mouse ICOS ligand to the mouse ICOS receptor.

Two additional cross-reactive mAbs, STIM002-B and STIM004, showed weaker human and mouse ICOS ligand neutralisation.

STIM006, STIM007, STIM008 and STIM009 showed neutralisation of human ICOS ligand but did not demonstrate significant cross-reactivity in the mouse ICOS ligand neutralisation system. Neutralising IC50 values for mouse B7-H2 ligand could not be calculated for these antibodies.

TABLE E8-1

Figure 2:
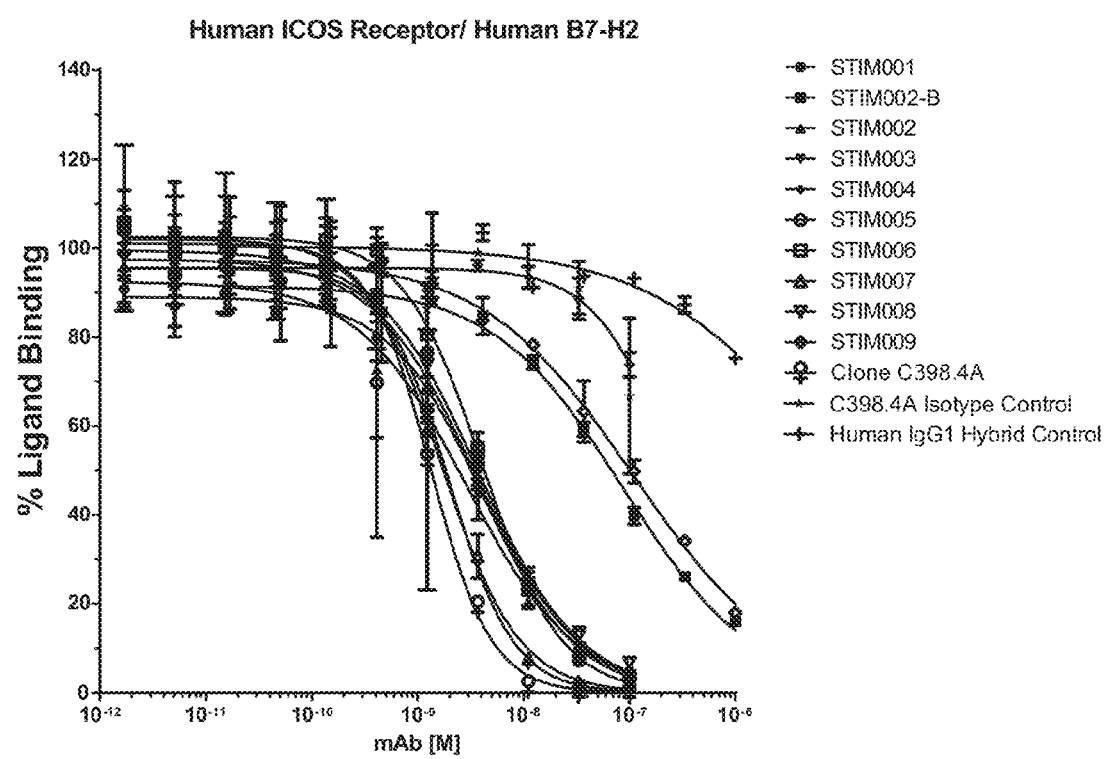
FIG. 2: Human ICOS-ligand neutralisation HTRF with human ICOS receptor. Neutralisation profiles of STIM001 to STIM009 anti-ICOS mAbs in human IgG1 format compared to C398.4A and respective isotype controls. Data representative of four experiments.

IC50 values for human IgG1 isotype mAb for neutralisation of human ICOS Receptor binding to human B7-H2. See also FIG. 2.

|           | Mean IC50 (nM) | SD (nM) (n = 4) |
|-----------|----------------|-----------------|
| STIM001   | 2.2            | 1.3             |
| STIM002   | 1.9            | 0.8             |
| STIM002-B | 3.6            | 3.5             |
| STIM003   | 1.3            | 0.5             |
| STIM004   | 233            | 123             |
| STIM005   | 2.5            | 0.8             |
| STIM006   | 2.2            | 1.5             |
| STIM007   | 1.1            | 0.5             |
| STIM008   | 1.6            | 1.4             |
| STIM009   | 30.5           | 53              |
| C398.4A   | 1.2            | 0.3             |

TABLE E8-2

Figure 3:
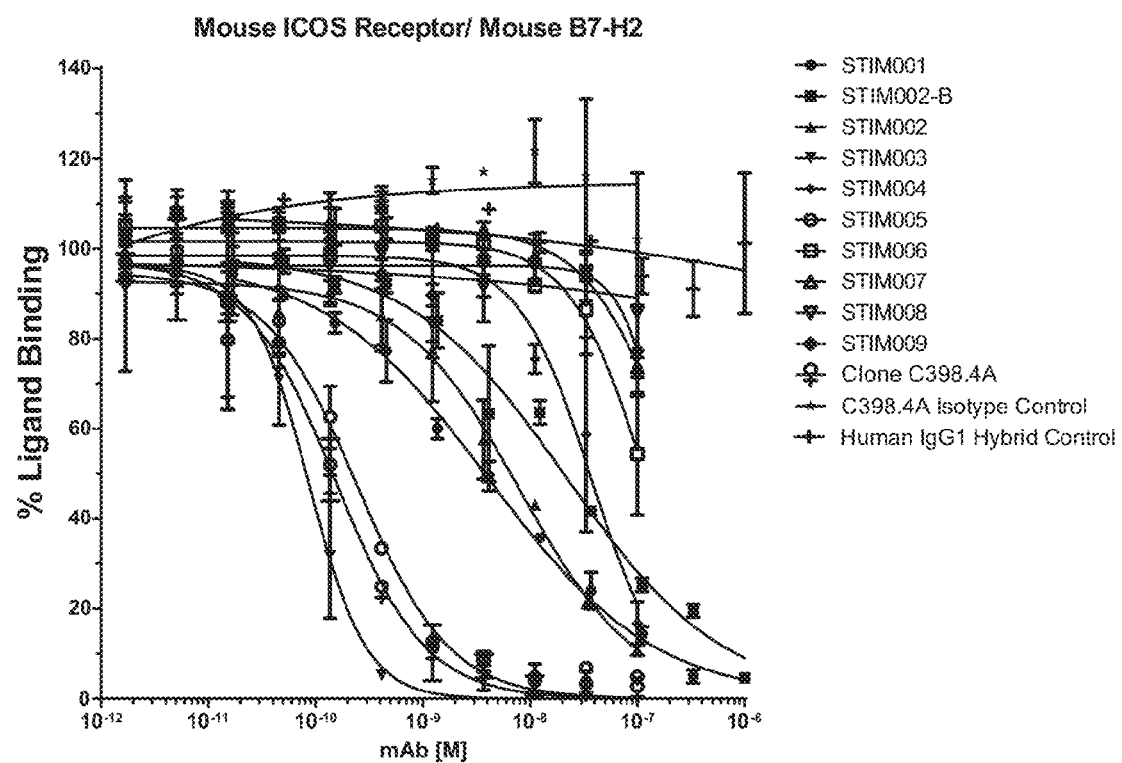
FIG. 3: Mouse ICOS-Ligand neutralisation HTRF with mouse ICOS receptor. Neutralisation profiles of STIM001 to STIM009 anti-ICOS mAbs in human IgG1 format compared to C398.4A and respective isotype controls. Data representative of three experiments.

IC50 values for human IgG1 isotype mAb for neutralisation of mouse ICOS Receptor binding to mouse B7-H2. See also FIG. 3.

|           | Mean IC50 (nM) | SD (nM) (n = 3) |
|-----------|----------------|-----------------|
| STIM001   | 6.5            | 2.5             |
| STIM002   | 6.9            | 2.1             |
| STIM002-B | 30             | 11.4            |
| STIM003   | 0.1            | 0               |
| STIM004   | 22.1           | 15.4            |
| STIM005   | 0.3            | 0.2             |
| C398.4A   | 0.1            | 0               |

IgG4.PE

As expected, IgG4.PE mAbs produced similar results to the IgG1 isotypes.

STIM001, STIM003 and STIM005 showed similar IC50 values to C398.4A using the human ICOS ligand neutralisation system. These mAbs were also cross-reactive at neutralising mouse ICOS ligand. STIM002-B and STIM004 produced weaker IC50 values for human ICOS B7-H2 neutralisation and mouse B7-H2 ligand. STIM007, STIM008 and STIM009 showed neutralisation of human ICOS ligand binding to human ICOS receptor but neutralising IC50 values for mouse B7-H2 ligand could not be calculated in these assays.

IgG4.PE isotypes of STIM006 and STIM002 were not assayed.

TABLE E8-3

Figure 4:
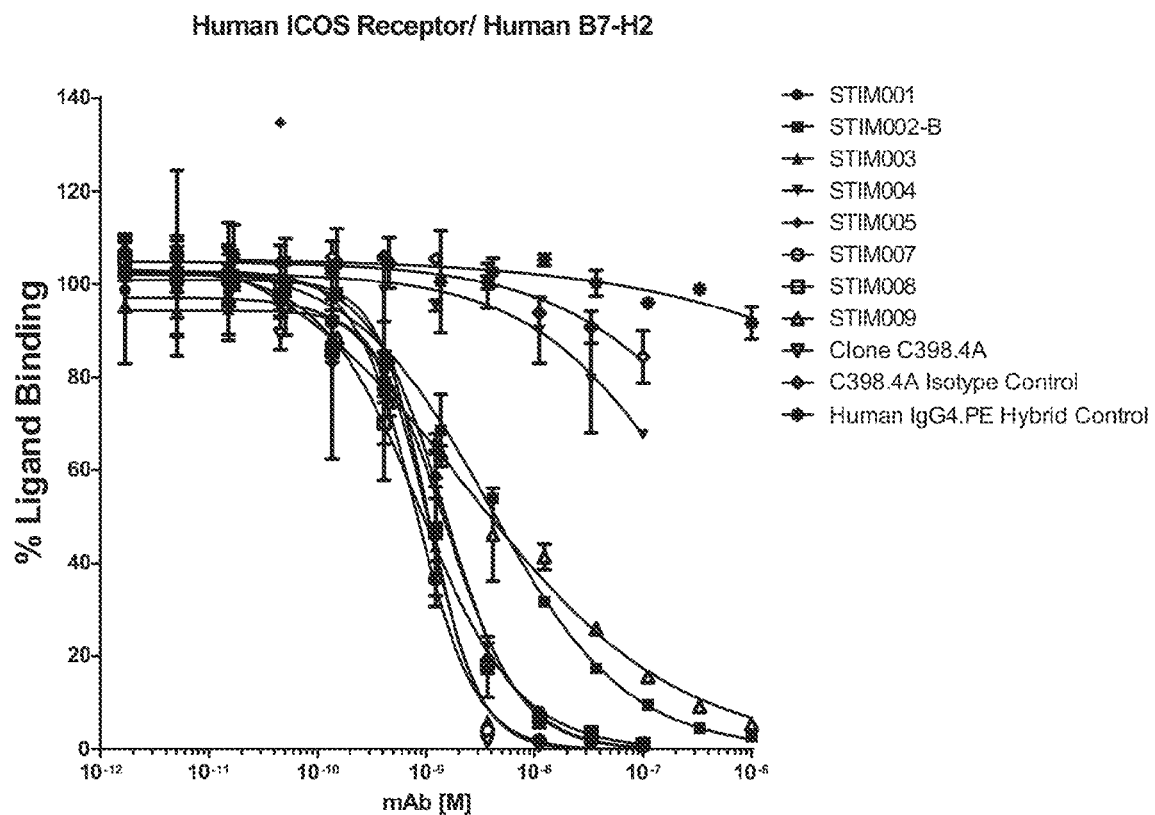
FIG. 4: Human ICOS-Ligand direct neutralisation HTRF with human ICOS receptor. Neutralisation profiles of STIM001 to STIM009 anti-ICOS mAbs in human IgG4.PE format compared to C398.4A and respective isotype controls. Data representative of four experiments.

IC50 values for human IgG4.PE isotype mAb for neutralisation of human ICOS Receptor binding to human B7-H2. See also FIG. 4.

|           | Mean IC50 (nM) | SD (nM) (n = 4 unless otherwise stated) |
|-----------|----------------|------------------------------------------|
| STIM001   | 1.3            | 0.2                                      |
| STIM002-B | 3.4            | 1.8                                      |
| STIM003   | 1.2            | 0.3                                      |
| STIM004   | 161            | 152 (n = 3)                              |
| STIM005   | 1.6            | 0.2                                      |
| STIM006   | 0.8            | (n = 1)                                  |
| STIM007   | 0.8            | 0.1                                      |
| STIM008   | 0.8            | 0.1                                      |
| STIM009   | 4.6            | 2.2                                      |
| C398.4A   | 2.8            | 3.8                                      |

TABLE E8-4

Figure 5:
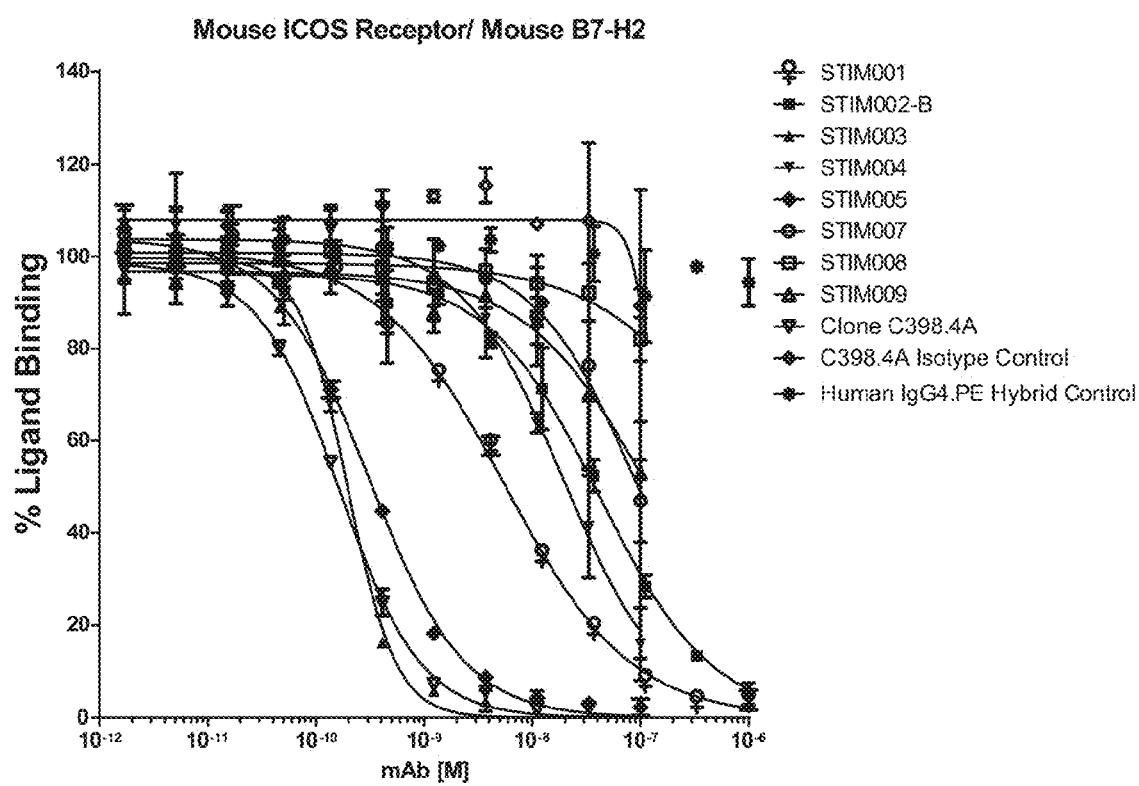
FIG. 5: Mouse ICOS-Ligand neutralisation HTRF with mouse ICOS receptor. Neutralisation profiles of STIM001 to STIM009 anti-ICOS mAbs in human IgG4.PE format compared to C398.4A and respective isotype controls. Data representative of four experiments.

IC50 values for human IgG4.PE isotype mAb for neutralisation of mouse ICOS Receptor binding to mouse B7-H2. See also FIG. 5.

|           | Mean IC50 (nM) | SD (nM) (n = 3) |
|-----------|----------------|-----------------|
| STIM001   | 4.7            | 2.1             |
| STIM002-B | 43.9           | 25.7            |
| STIM003   | 0.2            | 0.1             |
| STIM004   | 30             | 14              |
| STIM005   | 0.3            | 0.1             |
| C398.4A   | 0.2            | 0.1             |

Materials and Methods

Test antibodies and isotype controls were diluted in assay buffer (0.53 M Potassium Fluoride (KF), 0.1% Bovine Serum Albumin (BSA) in 1×PBS) from a starting working concentration of up to 4 µM, 1 µM final to 0.002 nM, 5.64e−4 nM final over 11 point titration, 1 in 3 dilutions. Titrations of 5 µl of antibody were added to 384w white walled assay plate (Greiner Bio-One). Positive control wells received 5 µl of assay buffer only.

5 µl of ICOS receptor (human ICOS-mFc, 20 nM, 5 nM final or mouse ICOS-mFc 4 nM, 1 nM final (Chimerigen)) was added to required wells. Plate was incubated for 1 hr at room temperature (RT). After incubation, 5 µl of either mouse or human ICOS ligand, (B7-H2, R&D Systems) conjugated to Alexa 647 (Innova Bioscience) was diluted to either 32 nM (8 nM final) for human B7-H2 or 30 nM, 7.5 nM final for mouse B7-H2 and added to all wells of assay plate except negative control wells which instead received 5 µl of assay buffer.

Finally, 5 µl of anti-mouse IgG donor mAb (Southern Biotech) labelled with europium cryptate (Cis Bio), 40 nM, 10 nM final was added to each well and the assay was left in the dark at RT to incubate for a further 2 hours. After incubation, assay was read on Envision plate reader (Perkin Elmer) using a standard HTRF protocol. 620 nm and 665 nm channel values were exported to Microsoft Excel (Microsoft) and % Delta-F and % Neutralisation calculations performed. Titration curves and IC50 values [M] were plotted using Graphpad (Prism). IC50 values were calculated by first transforming the data using equation X=Log (X). The transformed data was then fitted using nonlinear regression, using fitting algorithm, log (inhibitor) vs. response—variable slope (four parameters).
% Delta-F Calculation:
665/620 nm ratio for ratio metric data reduction.

$$\% \text{ Delta } F = \frac{(665/620 \text{ nm Well Signal Ratio} - \text{Signal Negative Control})}{(\text{Signal Negative Control})} * 100$$

Signal Negative control = average of minimum signal ratio.

% Neutralisation:

$$\% \text{ Max (neutralisation)} = \frac{(\% \text{ Delta-}F \text{ of sample well} - \text{Negative Control})}{(\text{Positive Control} - \text{Negative Control})} * 100$$

Example 9a: T-Cell Activation

STIM001 and STIM003 agonistic potential on cytokine production was tested in plate-bound and soluble format in a human primary T-cell activation assay where anti-CD3 and anti-CD28 Abs were added concurrently to the anti-ICOS Ab to induce ICOS expression on effector T-cells. Effect of the ICOS co-stimulation on the level of IFNγ produced by these activated T-cells were assessed using ELISA at 72 hrs post-activation.
Materials and Methods
T-Cell Activation Assay 1:
Isolation of Mononuclear Cells from Human Peripheral Blood (PBMC):

Leukocyte cones were collected from healthy donors and their content was diluted up to 50 ml with phosphate buffered saline (PBS, from Gibco) and layered into 2 centrifuge tubes on top of 15 mL Ficoll-Paque (from GE Healthcare). PBMC were separated by density gradient centrifugation (400 g for 40 min without brake), transfered to a clean centrifuge tube and then washed with 50 mL PBS, twice by centrifuging at 300 g for 5 min and twice by centrifuging at 200 g for 5 min. PBMC were then resuspended in R10 media (RPMI+10% heat-inactivated Fetal Bovine Serum, both from Gibco) and their cell count and viability assess with EVE™ Automated Cell Counter (from NanoEnTek).
ICOS Antibodies (Abs) Preparation and Dilutions:

STIM001 and STIM003 were tested in 3 formats: plate-bound, soluble or soluble plus F(ab')$_2$ Fragments (109-006-170 from Jackson Immuno Research) which crosslink the anti-ICOS Abs.

For plate-bound format: the anti-ICOS Abs and their isotype control were serially diluted 1:3 in PBS to give final antibody concentrations ranging from 45 to 0.19 µg/mL. 100 µL of diluted antibodies were coated in duplicate into a 96-well, high-binding, flat-bottom plate (Corning EIA/RIA plate) overnight at 4° C. Plate was then washed with PBS and 125 µl of R10 were added to each well.

For soluble format: The anti-ICOS Abs and their isotype control were serially diluted 1:3 in R10 media to give an 2× Ab stock concentrations ranging from 90 to 0.38 µg/mL. 125 µl of diluted Abs were pipetted in duplicate into a 96-well, flat-bottom plate.

For crosslinked soluble format: The anti-ICOS Abs and their isotype control were mixed with F(ab')$_2$ Fragments at 1M to 1M ratio. Abs/F(ab')$_2$ Fragments mixes were then 1:3 serially diluted in R10 media to give an 2× Ab concentrations ranging from 90 to 0.38 µg/mL for ICOS and from 60 to 0.24 µg/ml for F(ab')$_2$ Fragments. 125 µl of diluted Abs were pipetted in duplicate into a 96-well, flat-bottom plate.
T-Cell Isolation, Cultures and IFN-γ Quantification:

T-cell were negatively isolated from PBMC using the EasySep Human T Cell Isolation Kit (from Stemcell Technologies) and resuspended at 2×10$^6$/mL in R10 media supplemented with 40 µl/ml of Dynabeads Human T-Activator CD3/CD28 (from Life Technologies).

125 µl of T-cell suspension were added to Ab-containing plates to give a final cell concentration of 1×10$^6$ cells/ml and cultured for 72 hrs at 37° C. and 5% CO$_2$. Cell free supernatants were then collected and kept at −20° C. until analysis of secreted IFNγ by ELISA (duoset kit from R&D).

This experiment was repeated on T-cells isolated from 6 independent donors and 2 technical replicates were included for each assay condition.
T-Cell Activation Assay 2 (STIM-REST-STIM Assay):

STIM001 and STIM003 agonist potential on cytokine release were also tested plate-bound in a human T-cell assay where T-cells were prestimulated by anti-CD3 and anti-CD28 Abs for 3-days to induce ICOS expression before being rested for 3-days to reduce their activation levels. ICOS expression was confirmed by FACS staining after stimulation (Day 3) and resting (Day 6). These stimulated rested T-cells were then cultured with STIM001 or STIM003 in presence or absence of CD3 Ab to assess the requirement of TCR engagement. Effects of the ICOS co-stimulation were assessed after 72 hrs on the levels of IFNγ, TNFα and IL-2 present in the culture.
ICOS Abs Dilutions and Coating:

Anti-human CD3 (clone UCHT1 from eBioscience) was diluted in PBS to a 2× Ab concentration of 10 µg/mL. 50 µl of PBS or 50 µl of diluted CD3 Ab were pipetted into a 96-well, high-binding, flat-bottom plate. STIM001, STIM003 and their isotype control were 1:2 serially diluted in PBS to give final 2× antibody concentrations ranging from 20 to 0.62 µg/mL. 50 µL of diluted anti-ICOS Ab were added to wells containing either PBS (no TCR engagement) or diluted CD3 Ab (TCR engagement). Plates were coated overnight at 4° C.
T-Cell Isolation, Cultures and IFN-γ Quantification:

PBMC from leukocyte cones were obtained as described in T-cell activation assay 1. T-cell were negatively isolated from this PBMC using the EasySep Human T Cell Isolation Kit (from Stemcell Technologies). T-cells were resuspended at 1×10$^6$/ml in R10 media supplemented with 20 µl/mL of Dynabeads Human T-Activator CD3/CD28 (from Life Technologies) and cultured for 3-days at 37° C. and 5% CO$_2$ (Stimulation). At day 3 dynabeads were removed from the culture. T-cells were then washed (300 g for 5 min), counted and resuspended at 1.5×10$^6$/ml in R10 media and culture at 37° C. and 5% CO$_2$ for 3-more days (Resting phase).

At day 6 stimulated rested T-cells were then washed (300 g for 5 min), counted and resuspended at 1×10$^6$/mL in R10 media and 250 µl of T-cell suspension were added to ICOS Ab-coated plates and cultured for 72 hrs at 37° C. and 5% CO$_2$. Cell free supernatants were then collected and kept at −20° C. until analysis of secreted cytokines on the MSD platform. This experiment was repeated with T-cells isolated from 5 independent donors and 3 technical replicates were included for each assay condition.

Results

Both STIM001 and STIM003 tested positive for inducing IFNγ expression therefore demonstrating agonism in both assays.

Example 9b: T Cell Activation Assay 1 Data

T cell activation assay 1 was performed as described in Example 9a, using T cells isolated from 8 independent donors, testing each of STIM001 and STIM003 in human IgG1 format. Hamster anti-ICOS antibody C398.4A and a hamster antibody isotype control were included for comparison. 2 technical replicates were included for each assay condition.

Figure 16:
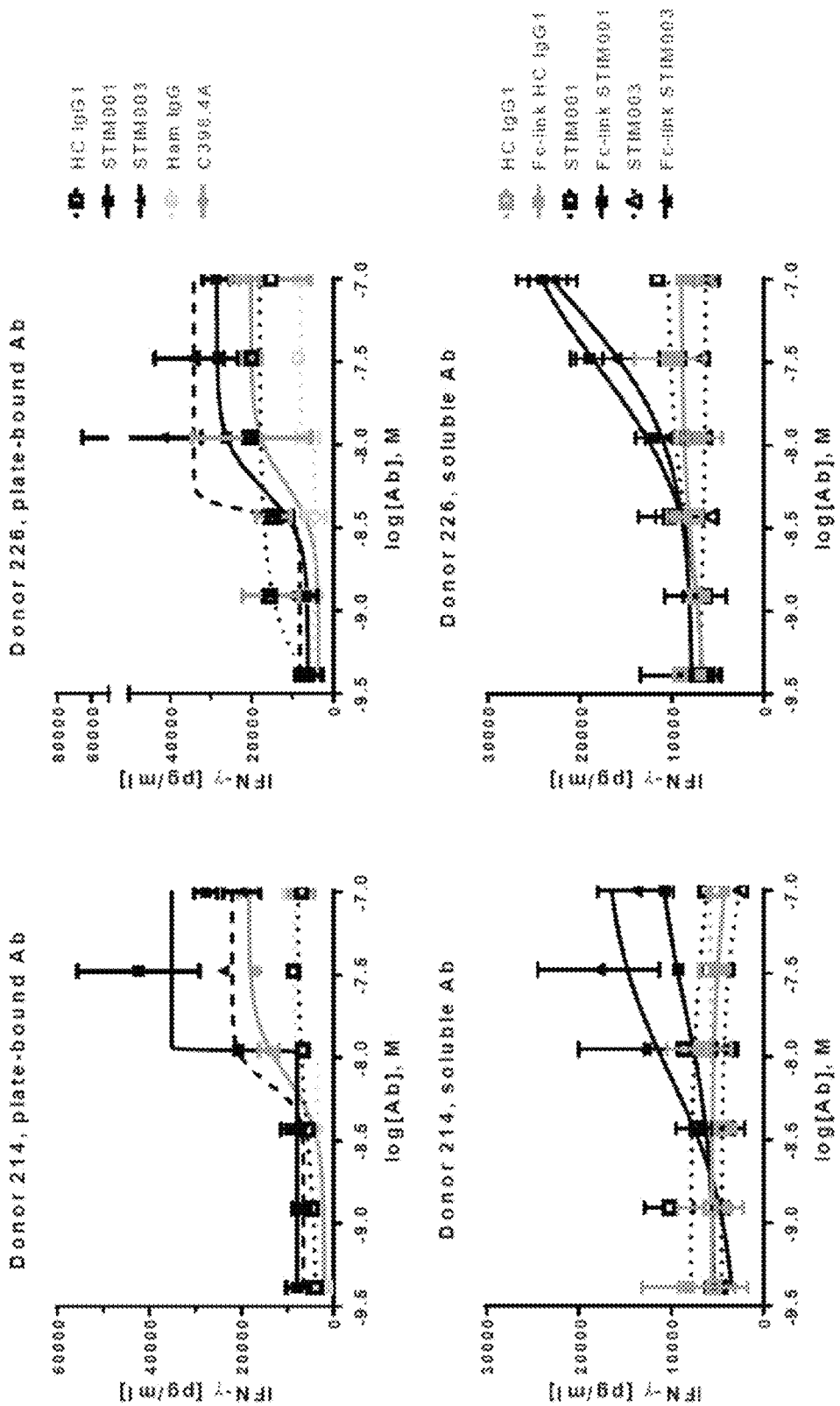
FIG. 16: Example data from concentration-dependent study of STIM001 (hIgG1) and STIM003 (hIgG1) agonist effect on isolated human T-cells co-stimulated with anti-CD3/anti-CD28 dynabeads for 3-days in T cell activation assay 1 (see Example 9b). IFN-γ production was used as an indicator of the agonistic effect. STIM001 (hIgG1) and STIM003 (hIgG1) were tested in plate-bound, soluble or crosslinked soluble (Fc-linked Ab) formats and compared with a hybrid isotype control (HC hIgG1). Included for comparison in the plate-bound assay was hamster antibody C398.4A and its isotype control (hamster IgG). Upper panel shows data from plate-bound antibodies. Lower panel shows data from IgG1 antibodies in soluble and cross-linked forms. Left and right panels respectively use T cells from two independent human donors.
Figures 17A, 17B:
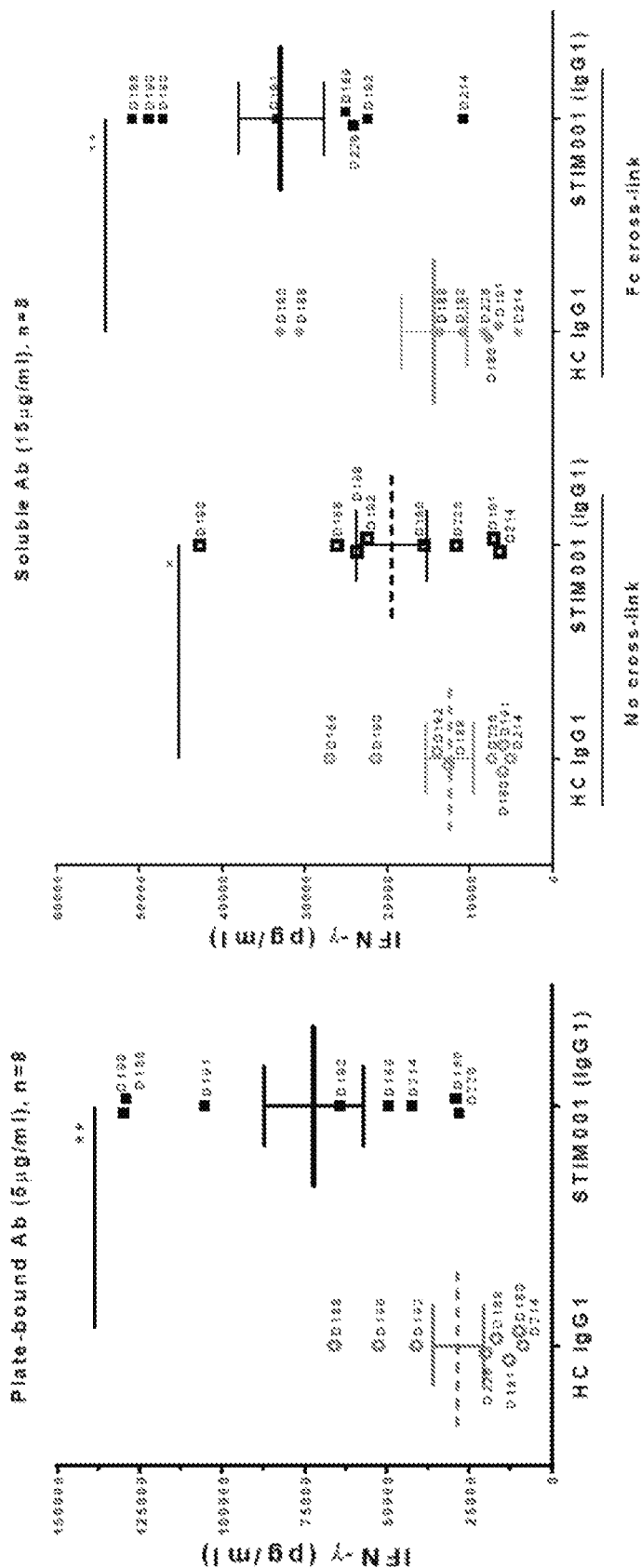
FIG. 17A and FIG. 17B: Example data set for STIM001 in T cell activation assay 1 (see Example 9). Data indicate levels of IFN-γ induced by STIM001 (hIgG1) or its hybrid isotype control (HC IgG1) at one given dose for T cells from 8 independent human donors. Plate-bound antibody (FIG. 17A) was used at 5 μg/ml. Soluble antibody (FIG. 17B) was used at 15 μg/ml. Each dot represents one donor, identified by number (D214 for example). Significance was assessed using Wilcoxon statistic test: *, p<0.05 and **, p<0.01.
Figures 18A, 18B:
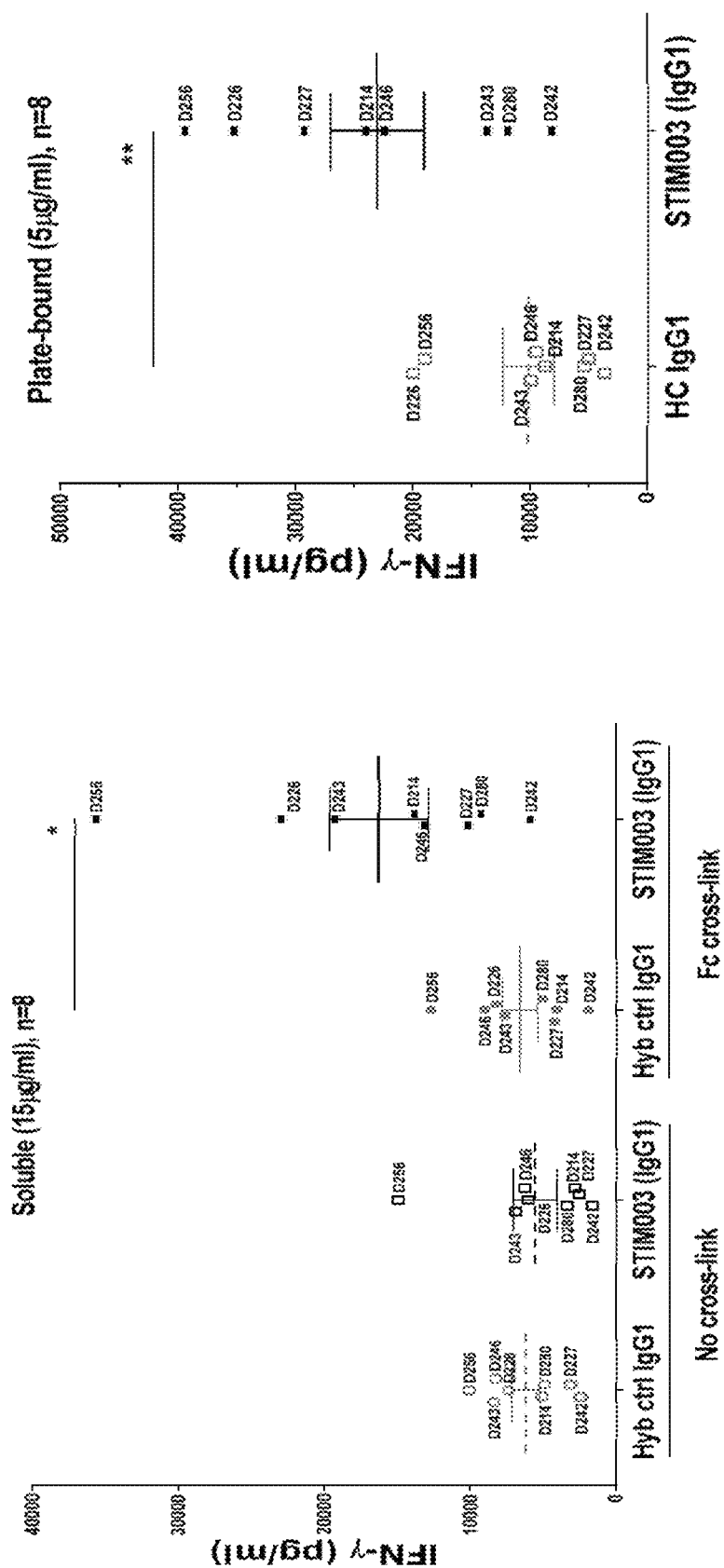
FIG. 18A and FIG. 18B: Example data set for STIM003 in T cell activation assay 1 (see Example 9). Data indicate levels of IFN-γ induced by STIM003 (hIgG1) or its hybrid isotype control (HC hIgG1) at one given dose for T cells from 8 independent human healthy donors. Soluble antibody (FIG. 18A) was used at 15 μg/ml. Plate-bound antibody (FIG. 18B) was used at 5 μg/ml. Each dot represents one donor, identified by number (D214 for example). Significance was assessed using Wilcoxon statistic test: *, p<0.05 and **, p<0.01.
Figure 19A:
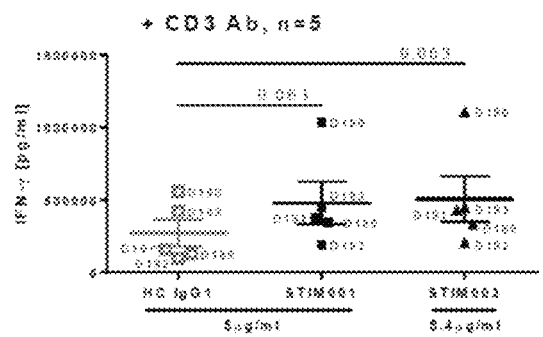
FIG. 19A, FIG. 19B, FIG. 19C, FIG. 19D, FIG. 19E, and FIG. 19F: Example data from T cell activation assay 2 (see Example 9c). Study of STIM001 (hIgG1) and STIM003 (hIgG1) agonist effect on isolated human T-cells stimulated with anti-CD3/anti-CD28 dynabeads for 3-days, then rested in medium for 3-days and finally re-stimulated with plate-bound STIM001, STIM003 or C398.4A Ab+/−CD3 Ab. Data comparing levels of IFN-γ (FIG. 19A and FIG. 19B), TNF-α (FIG. 19C and FIG. 19D) and IL-2 (FIG. 19E and FIG. 19F) induced by STIM001, STIM003 vs their hybrid control IgG1 (FIG. 19A, FIG. 19C, and FIG. 19E) or C398.4A vs its hamster IgG control (FIG. 19B, FIG. 19D, and FIG. 19F) at one given dose and in combination with CD3 Ab (TCR engagement). Each dot represents an independent donor identifiable by its number (D190 for example). Statistical significance between the Abs and their isotype control was assessed using Wilcoxon statistic test and p value indicated. Note that STIM003 concentration was slightly different to those of HC IgG1 (5.4 vs 5 μg/ml).
Figure 19B:
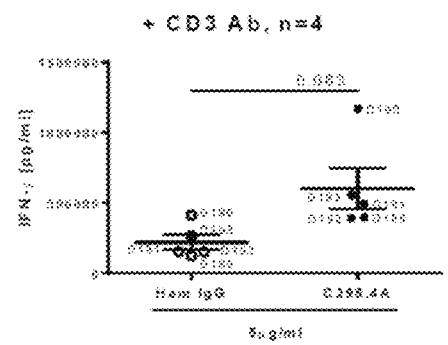
Figure 19C:
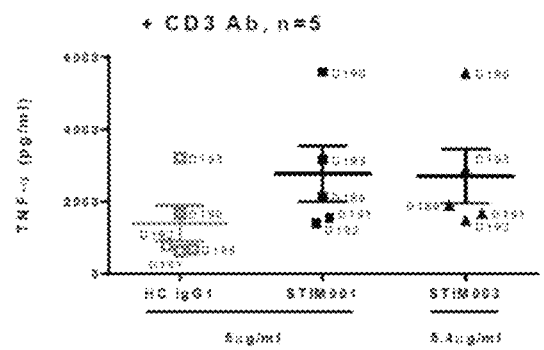
Figure 19D:
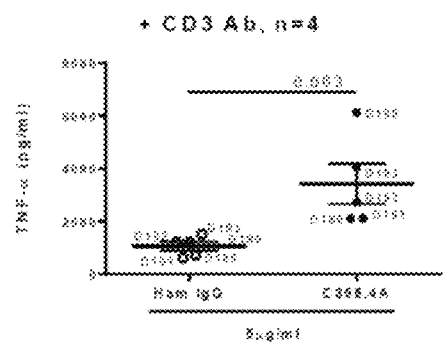
Figure 19E:
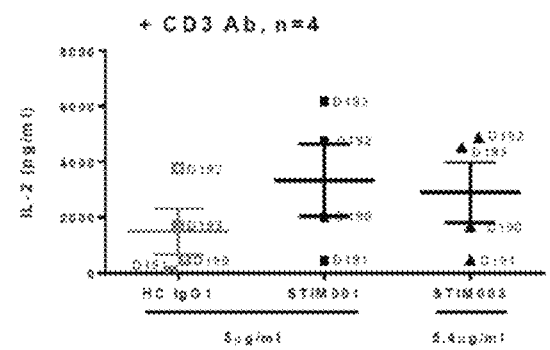
Figure 19F:
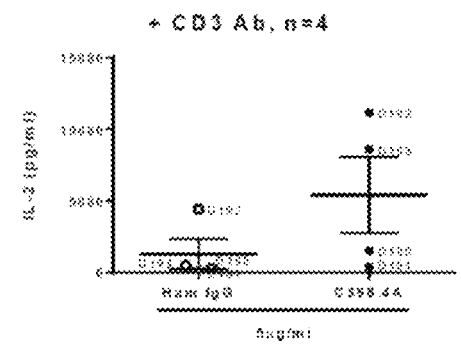

Results are shown in FIG. 16, FIG. 17 and FIG. 18. As noted before, both STIM001 and STIM003 tested positive for inducing IFNγ expression therefore demonstrating an agonistic effect on human primary T cells.

Cross-linked antibodies acted as agonists of T cell activation, as indicated by the strong enhancement of IFNγ induction in the presence of the Fc-linking F(ab')$_2$ fragments, compared with either soluble antibody or with control. IFNγ expression in the T cells increased with increasing concentration of cross-linked STIM001 or STIM003 (FIG. 16, lower panels). Agonism was also observed for both STIM001 and STIM003 in plate-bound form and, more weakly, for the hamster antibody C398.4A, as indicated by the increase in IFNγ expression observed in the T cells with increasing concentration of antibody (FIG. 16, top panels).

Magnitude of the IFNγ response varied between T cells obtained from different donors, but STIM001 consistently produced an increase in IFNγ expression in T cells compared with IFNγ expression observed with control antibody (HC IgG1). When considering data from assays with T cells from all 8 donors, it is seen that treatment of T cells with STIM001 significantly increased IFNγ expression compared with treatment with isotype control antibody, in plate-bound form, soluble form and cross-linked form (FIG. 17). STIM001 thus behaved as an agonist of T cell activation in all three formats.

Similar effects were observed with STIM003 (FIG. 18). Levels of IFNγ induced by STIM003 hIgG1 were compared with levels of IFNγ induced by its isotype control (HC IgG1) at a given dose of antibody in the assay, for 8 independent donors. Despite the variability between donors, the mean increase in IFNγ level induced by STIM003 was significant when compared against HC IgG1. It is proposed that STIM001, and the other STIM antibodies described here, have the potential to similarly promote T cell activation in vivo. As discussed previously, agonism of activated ICOS-expressing T cells may be mediated by the anti-ICOS antibody binding to and inducing multimerisation of the ICOS receptor on the T cell surface. Example 9c: T cell activation assay 2 data T cell activation assay 2 was performed as described in Example 9a.

In the absence of TCR engagement (no anti-CD3 antibody), levels of cytokines produced from the primary T cells were low and no increase was induced by STIM001 (hIgG1), STIM003 (hIgG1) or antibody C398.4A even at the highest concentration of 10 µg/ml. In contrast, when the anti-ICOS antibodies were added to T cells in combination with the anti-CD3 antibody, each of STIM001 (hIgG1), STIM003 (hIgG1) and C398.4A showed a dose-dependent trend to increase expression of IFNγ, TNFα and, to a lesser degree, IL-2.

Data from primary T cells treated with anti-ICOS antibodies under conditions of TCR engagement are shown in FIG. 19. Although marked increases in cytokine expression were observed for each of STIM001, STIM003 and C389.4A relative to their respective isotype controls, the difference did not reach statistical significance in this assay. Further replicates of the assay with responsive primary T cells from more donors would be expected to generate statistically significant results.

Example 10a: ADCC Assay

STIM001 and STIM003 potential to kill via ADCC was tested in the Delfia BATDA cytotoxicity assay (Perkin Elmer) using human primary NK cells as effector and ICOS high MJ cell line (ATCC, CRL-8294) as target cells. MJ cells are human CD4 T-lymphocyte cells that express high levels of ICOS protein.

This method is based on loading target cells with an acetoxymethyl ester of fluorescence enhancing ligand (BATDA) which quickly penetrates the cell membrane. Within the cell the ester bonds are hydrolysed to form a hydrophilic ligand (TDA) which no longer passes the membrane. After cytolysis the ligand is released and can be detected by addition of Europium which forms with the BATDA a highly fluorescent and stable chelate (EuTDA). The measured signal correlates directly with the amount of lysed cells.

Materials and Methods

Target Cell Labelling:

According to the manufacturer's instructions, MJ cells were resuspended at $1 \times 10^6$/mL in assay media (RPMI+10% ultra-low IgG FBS, from Gibco) and loaded with 5 µl/mL of Delfia BATDA reagent (Perkin Elmer) for 30 min at 37° C. MJ cells were then washed 3 times with 50 mL PBS (300 g for 5 min) and resuspended at $8 \times 10^5$/ml in assay media supplemented with 2 mM Probenecid (from Life technologies) to reduce BATDA spontaneous release from the cells. ICOS Ab Dilution:

STIM001, STIM003 and their isotype control were 1:4 serially diluted in assay media+2 mM Probenecid to give final 4× antibody concentrations across a range down to 80 pg/mL.

NK-Cell Isolation and Culture:

PBMC from leukocyte cones were obtained as described in T-cell activation assay 1. NK-cell were negatively isolated from this PBMC using the EasySep Human NK Cell Isolation Kit (from Stemcell Technologies) and resuspended at $4 \times 10^6$/ml in R10 media+2 mM Probenecid. NK cell purity was checked to be above 90% by staining for CD3−/CD56+.

50 µl of diluted Ab, 50 µl of BATDA loaded MJ cells, 50 µl of NK cells and 50 µl of assay media+2 mM Probenecid (final volume of 200 µl/well) were added in each well to give a final Ab concentration across a range downto 20 pg/mL and an effector:target ratio of 5:1. Wells containing MJ cells only or MJ cells+delfia lysis buffer (Perkin Elmer) are used to determine spontaneous and 100% BATDA release.

The assay was run at 37° C., 5% $CO_2$ for 2 hrs before transferring 50 µl of cell-free supernatant into a DELFIA Microtitration Plates (Perkin Elmer). 200 µl of Delfia Europium solution (Perkin Elmer) was added to the supernatants and incubated for 15 min at Room Temperature. Fluorescent signal was then quantified with EnVision Multilabel Reader (PerkinElmer).

Figure 6A:
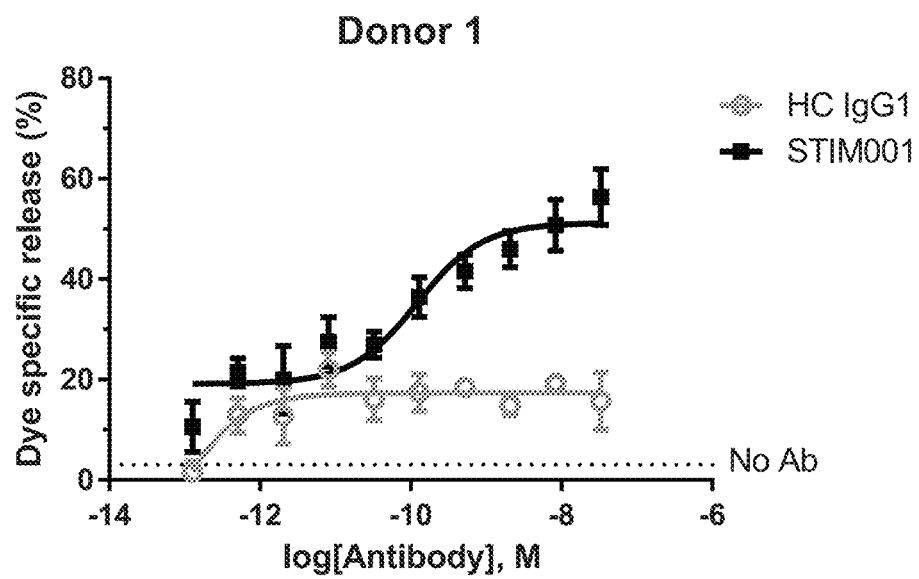
FIG. 6A: Concentration-dependent study of STIM001-mediated ADCC on MJ cells by using freshly isolated NK cells as effector cells. The effector cells and target cells (effector:target ratio of 5:1) were incubated together with antibody for 2 hours. BATDA releasing from lysed target cells was measured as described in the manufacturer kit instruction. HC is the hybrid isotype control.
Figure 6B:
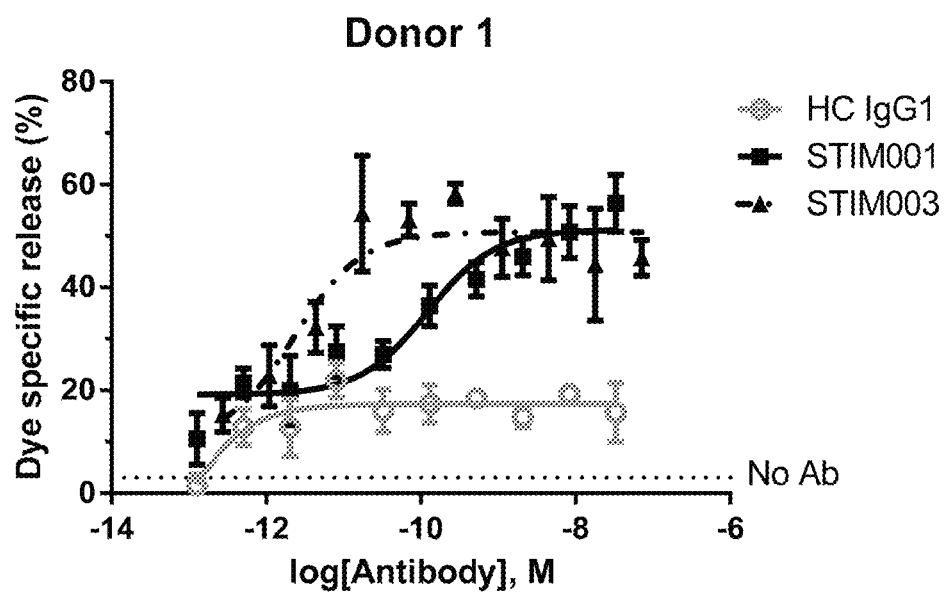
FIG. 6B, FIG. 6C, and FIG. 6D: Concentration-dependent study of STIM001 and STIM003-mediated ADCC on MJ cells with freshly isolated NK cells as effector cells. The effector cells and target cells (effector:target ratio of 5:1) were incubated together with antibody for 2 hours. BATDA releasing from lysed target cells was measured as described in the manufacturer kit instruction. HC is the hybrid isotype control.
Figure 6C:
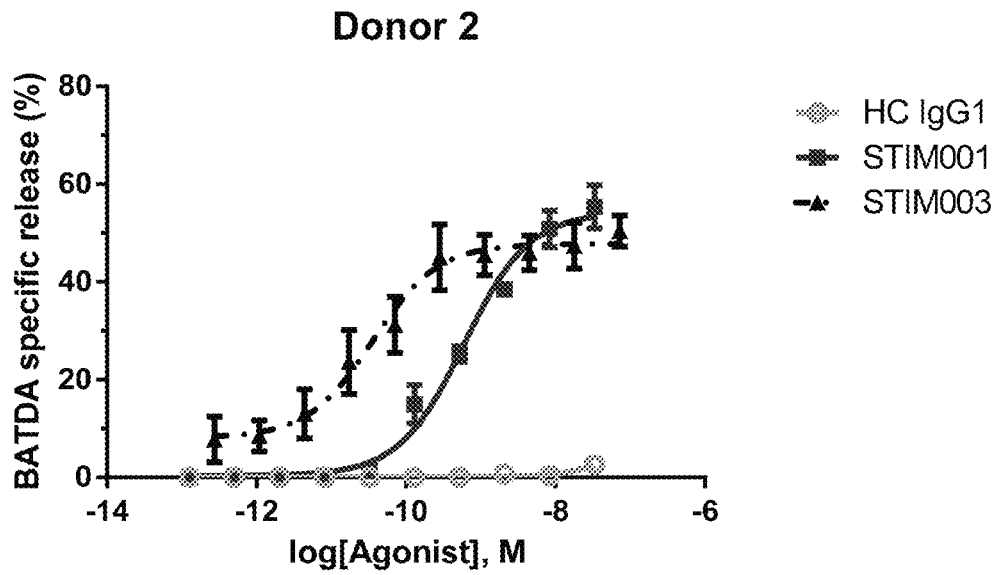
Figure 6D:
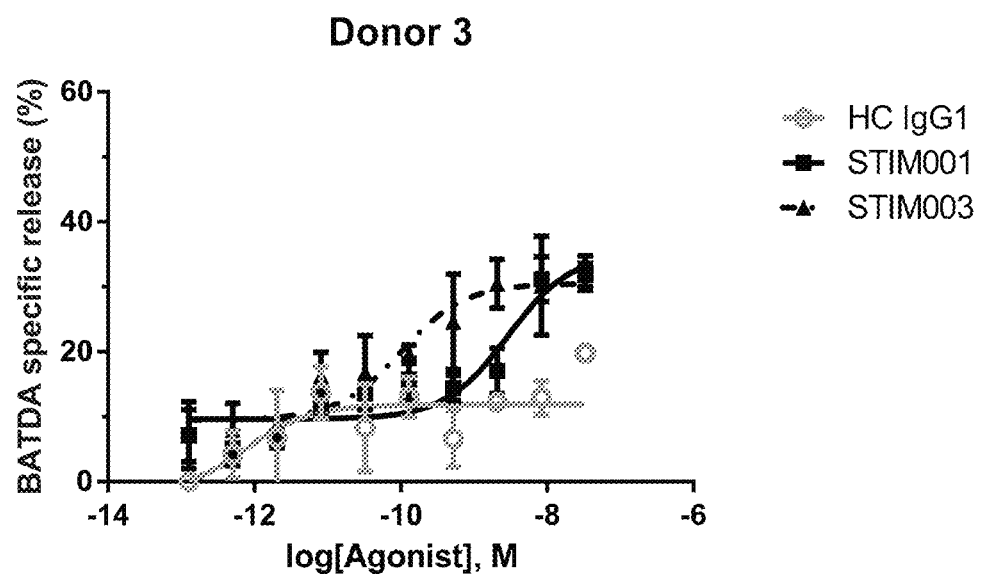
Figure 6E:
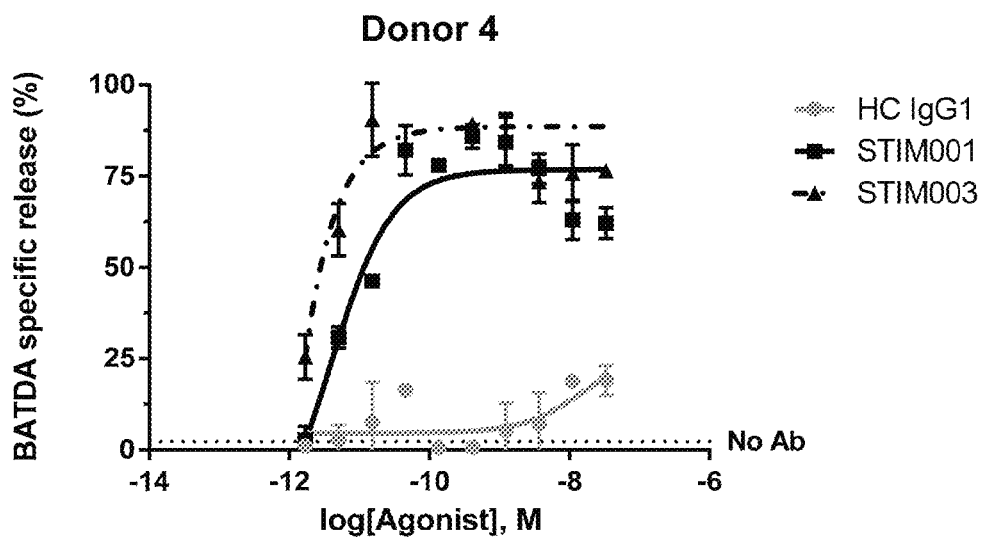
FIG. 6E, FIG. 6F, and FIG. 6G: Concentration-dependent study of STIM001 (hIgG1) and STIM003 (hIgG1)-mediated ADCC on ICOS-transfected CCRF-CEM cells with freshly isolated NK cells as effector cells. The effector cells and target cells (effector:target ratio of 5:1) were incubated together with antibody for 4 hours. BATDA releasing from lysed target cells was measured as described in the manufacturer kit instruction. HC is the hybrid isotype control.
Figure 6F:
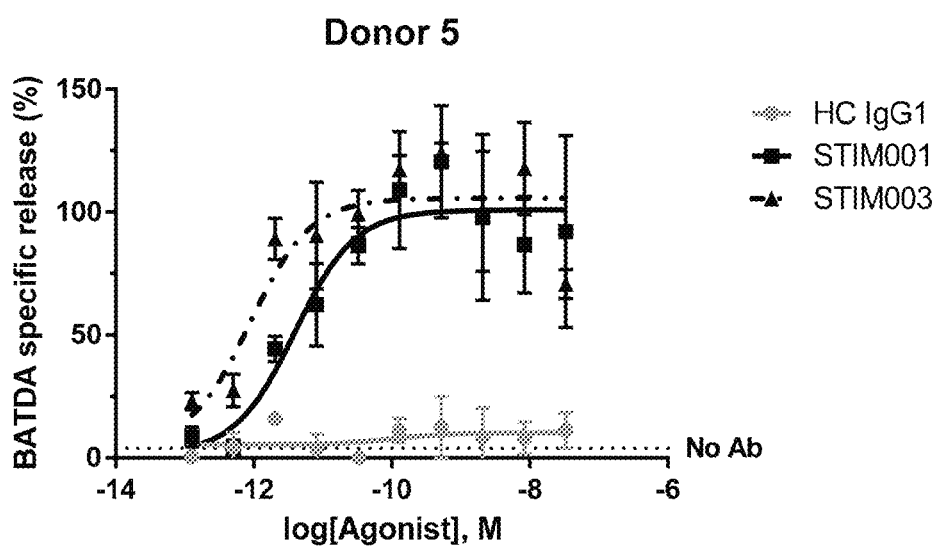
Figure 6G:
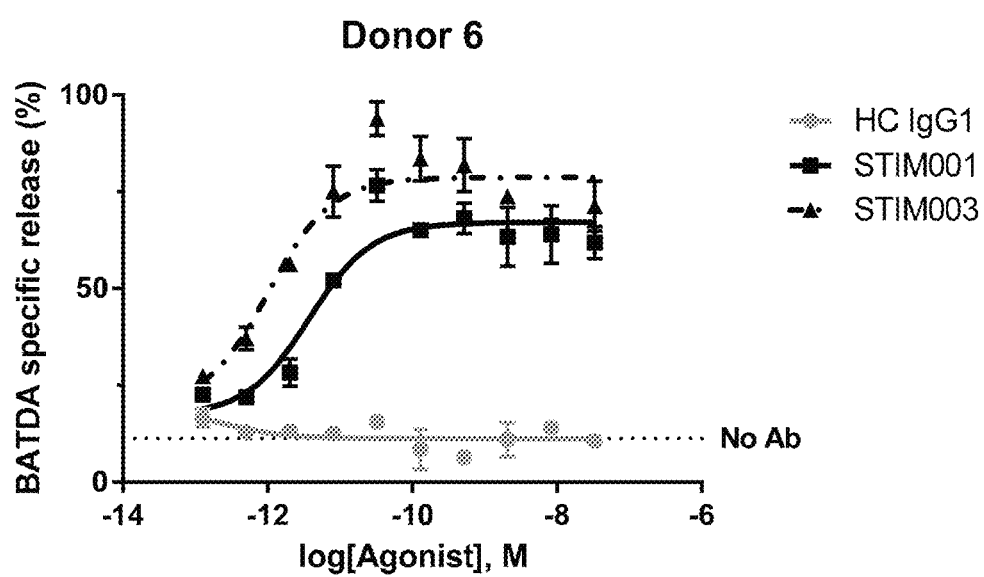

Specific release induced by STIM001 and STIM003 was calculated according to the kit instructions. This experiment was repeated with NK-cells from independent donors and 3 technical replicates were included for each assay condition. Results Anti-ICOS antibodies STIM001 (hIgG1) and STIM003 (hIgG1) kill ICOS positive human MJ cells in a primary NK dependent ADCC assay (2 hour time point). See also FIG. 6*a*. Sub-Nanomolar EC50 were achieved in this assay for both molecules tested.

TABLE E10-1

EC50 (Molar unit) of STIM001 in the NK primary cells ADCC assay from 2 donors (2 hour time point).

| EC50 | Donor 1 | Donor 2 |
| --- | --- | --- |
| STIM001 | 1.21e−10 | 5.29e−10 |

Example 10b: ADCC Assay with MJ Target Cells

The experiment was performed according to the Materials and Methods set out in Example 10a. STIM001, STIM003 and isotype control were 1:4 serially diluted in assay media+2 mM Probenecid to give final 4× antibody concentrations ranging from 40 μg/mL to 80 pg/mL. 50 μl of diluted Ab, 50 μl of BATDA loaded MJ cells, 50 μl of NK cells and 50 μl of assay media+2 mM Probenecid (final volume of 200 μl/well) were added in each well to give a final Ab concentration ranging from 10 μg/mL to 20 pg/mL and an effector:target ratio of 5:1.

Results are shown in FIG. 6 (b-d) and in the table below. STIM001 (hIgG1) and STIM003 (hIgG1) killed ICOS positive human MJ cells in the primary NK dependent ADCC assay, measured at the two hour time point.

TABLE E10-2

EC50 (Molar unit) of STIM001 and STIM003 in the NK primary cell ADCC assay from 3 donors (2 hour time point).

| EC50 | Donor 1 | Donor 2 | Donor 3 |
| --- | --- | --- | --- |
| STIM001 | 1.21e−10 (0.121 nM) | 5.29e−10 (0.529 nM) | 2.92e−09 (2.92 nM) |
| STIM003 | 2.33e−12 (2.33 pM) | 3.58-e−11 (35.8 pM) | 1.01e−10 (0.101 nM) |

Example 10c: ADCC Assay with ICOS-Transfected CCRF-CEM Target Cells

STIM001 and STIM003 hIgG1 potential to kill via ADCC was further tested in the Delfia BATDA cytotoxicity assay (Perkin Elmer) using human primary NK cells as effector and ICOS-transfected CCRF-CEM cells (ATCC, CRL-119) as target cells. CCRF-CEM is a human T lymphoblast line, originating from peripheral blood from a patient with acute lymphoblastic leukaemia. Antibody-mediated killing of CCRF-CEM cells was confirmed for both STIM001 and STIM003 in this assay.

Materials and Methods

Materials and Methods were as set out in Example 10a, but using CCRF-CEM cells obtained from ATCC (ATCC CCL-119) rather than MJ cells as the target cells, and using an incubation time of 4 hours.

CCRF-CEM cells were transfected with ICOS. A synthetic string DNA encoding full length human ICOS (with signal peptide, as shown in the appended sequence listing), codon-optimised for mammalian expression, was cloned into an expression vector under control of the CMV promoter and flanked by 3' and 5' piggyBac specific terminal repeat sequences facilitating stable integration into the cell genome (see [40]). The expression vector contained a puromycin selection cassette to facilitate stable cell line generation. The human ICOS expression plasmid was co-transfected with a plasmid encoding piggyBac transposase into CEM CCRF cells by electroporation. 24 hours after transfection, the media was supplemented with puromycin and grown for at least two weeks to select stable cell lines, with media being exchanged every 3-4 days. The expression of human ICOS was assessed by flow cytometry using an anti-human ICOS-PE conjugated antibody (eBioscience). Complete CEM media was made up of Advanced RPMI Medium containing 10% (v/v) FBS and 2 mM Glutamax.

STIM001 (hIgG1), STIM003 (hIgG1) and an isotype control antibody (HC IgG1) were serially diluted in assay media to give final 4× antibody concentrations ranging from 20 μg/mL to 80 pg/mL.

50 μl of diluted Ab, 50 μl of BATDA loaded ICOS-transfected CEM cells, 50 μl of NK cells and 50 μl of assay media (final volume of 200 μl/well) were added in each well to give a final Ab concentration ranging from 5 μg/mL to 20 pg/mL and an effector:target ratio of 5:1.

Results

STIM001 (hIgG1) and STIM003 (hIgG1) killed ICOS-transfected CCRF-CEM cells in the primary NK dependent ADCC assay, measured at the four hour time point. Results are shown in FIG. 6 (e-g) and in the table below.

TABLE E10-3

EC50 (Molar unit) of STIM001 and STIM003 in the NK primary cell ADCC assay from 3 donors (4 hour time point).

| EC50 | Donor 4 | Donor 5 | Donor 6 |
| --- | --- | --- | --- |
| STIM001 | 3.92e−12 (3.92 pM) | 3.95e−12 (3.95 pM) | 3.75e−12 (3.75 pM) |
| STIM003 | Approx 3 pM* | 8.95e−13 (0.895 pM) | 1.03e−12 (1.03 pM) |

*Value estimated from incomplete curve.

Example 11a: CT26 Syngeneic Model

Improved anti-tumour in vivo efficacy was shown in a CT26 syngeneic model by combining anti-ICOS (STIM001 mIgG2a, effector enable) with anti-PDL1 (10F9G2).

Materials and Methods

Efficacy studies were performed in Balb/c mice using the sub-cutaneous CT26 colon carcinoma model (ATCC, CRL-2638). This model is poorly sensitive to PD1/PDL1 blockade and only tumour growth delay (no stable disease or cure) is usually observed in response to 10F9.G2 (anti-PDL1) and RMT1-14 (anti-PD1) monotherapies. Therefore this model constitutes a relevant model for looking at anti-PD1, anti-PDL1 intrinsic resistance for combination studies. All in vivo experiments were performed in accordance with the UK Animal (Scientific Procedures) Act 1986 and the EU Directive 86/609, under a UK Home Office Project Licence and approved by the Babraham Institute Animal Welfare and Ethical Review Body.

Balb/c mice were supplied by Charles River UK at 6-8 weeks of age and >18 g and housed under specific pathogen-free conditions. A total of $1 \times 10^5$ CT26 cells (passage number below P20) were subcutaneously injected into the left flanks of mice. Unless stated otherwise, treatment were initiated at day 6 post tumour cells injection. The CT26 cells were passaged in vitro by using Accutase (Sigma), washed twice in PBS and resuspended in RPMI supplemented with 10% fetal calf serum. Cell viability was confirmed to be above 90% at the time of tumour cell injection.

For in vivo studies STIM001 anti-ICOS agonist (cross reactive to mouse ICOS protein) was reformatted as mouse IgG1 and mouse IgG2a to test the as effector function null and as effector function enable, respectively. The Anti-PDL1 was sourced from Biolegend (Cat.no:124325). The hybrid controls were generated in Kymab (mIgG2a isotype) or from commercial source (hamster isotype HTK888, Biolegend (Part No92257, Lot B215504)). All antibodies were dosed intraperitoneal (IP) at 10 mg/kg (1 mg/ml in 0.9% saline) three times a week from day 6 (dosing for 2 weeks day 6-18)

as monotherapies or by combining anti-PDL1 with anti-ICOS antibodies. Animal weight and tumour volume were measured 3 times per week from the day of tumour cell injection. Tumour volume was calculated by use of the modified ellipsoid formula 1/2(Length×Width2). Mice were kept on studies until their tumour reached an average diameter of 12 mm³ or, in rare case, when incidence of tumour ulceration was observed (welfare). The experiment was stopped at day 50. The human endpoint survival statistics were calculated using the Kaplan-Meier method with Prism. This approach was used to determine if specific treatments were associated with improved survival.

TABLE E11-1

Treatment groups

| Groups | Number of animals | Treatments (T.I.W, IP from day 6) |
|---|---|---|
| 1 | 10 | 10 mg/kg mIgG2a and 10 mg/kg IgG isotype Control (HTK888) |
| 2 | 10 | 10 mg/kg Anti-ICOS STIM001 mIgG1 |
| 3 | 10 | 10 mg/kg Anti-ICOS STIM001 mIgG2a |
| 4 | 10 | 10 mg/kg Anti-PD-L1 (10F9.G2) |
| 5 | 10 | 10 mg/kg anti-PD-L1 plus 10 mg/kg Anti-ICOS STIM001 mIgG1 |
| 6 | 10 | 10 mg/kg anti-PD-L1 plus 10 mg/kg Anti-ICOS STIM001 mIgG2a |

Results

Figure 7:
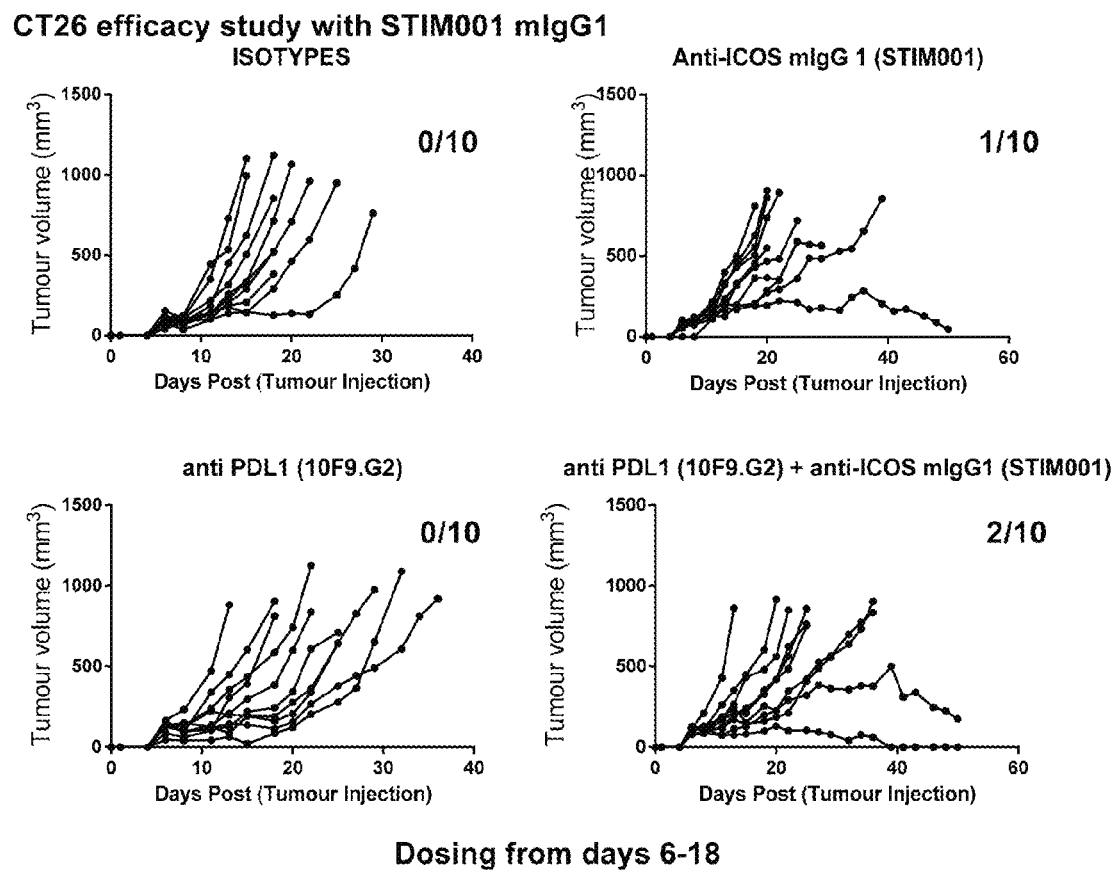
FIG. 7, FIG. 8, and FIG. 9: Anti-ICOS antibody inhibits CT26 tumour growth and improved survival when dosed as monotherapy or in combination with anti-PDL1. The STIM001 mIgG2a is more potent than the mIgG1 format. The number of animals cured or with stable disease is indicated on each graph.
Figure 8:
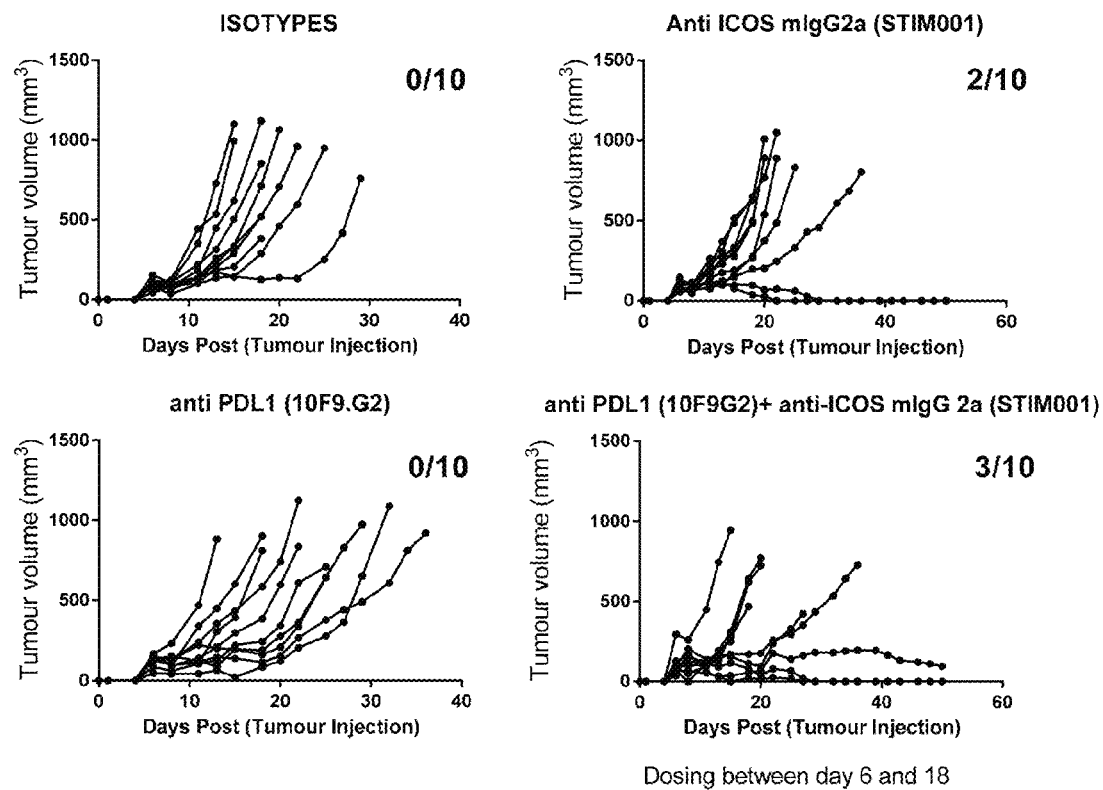
Figure 9:
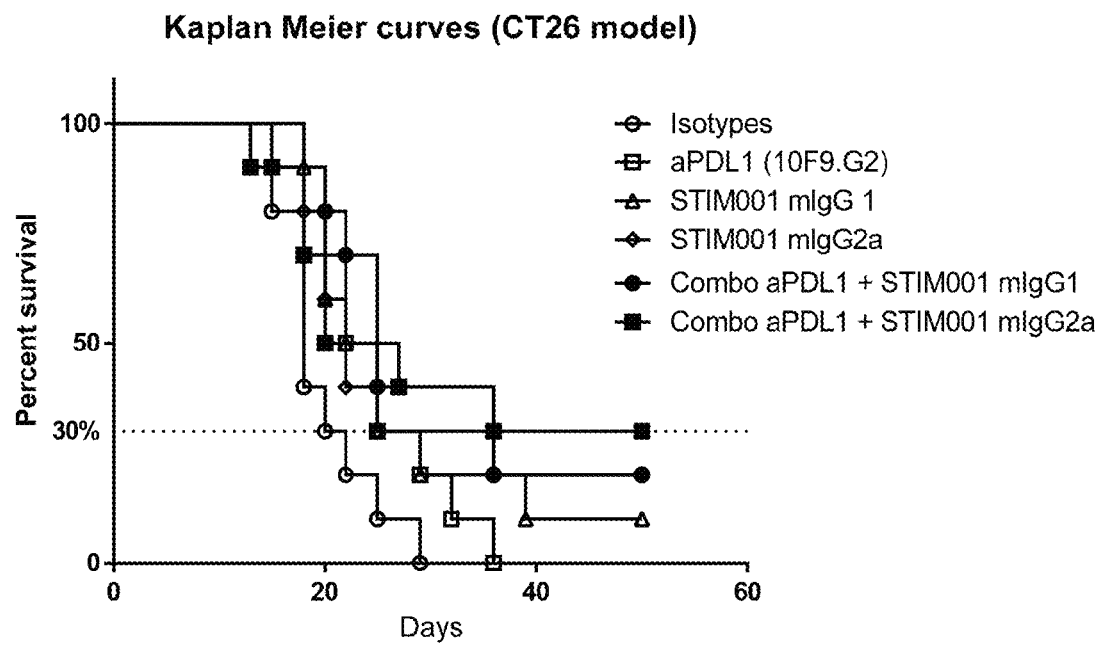

As shown in FIG. 7, FIG. 8 and FIG. 9, ICOS agonists can delay disease progression and cure a proportion of animals from the CT-26 subcutaneous tumours either as a monotherapy or in combination with anti-PDL1. Anti-PDL1 monotherapy induced tumour growth delay but no stable disease or curative potential was observed. The combination was more effective at treating the tumours than the anti-ICOS monotherapies. This study also highlighted that STIM001 in the mouse IgG2a format (effector function enable) was more potent than the mouse IgG1 (effector null) format at triggering an anti-tumour response in this model.

Example 11b: Strong Anti-Tumour Efficacy In Vivo in CT26 Syngeneic Model for Combination of Anti-ICOS mIgG2a with Anti-PDL1 mIgG2a An in vivo combination study was performed with STIM001 with a mouse cross reactive anti-human PDL1 antibody designated AbW. For this in vivo work, STIM001 was reformatted as mouse IgG1 and mouse IgG2a to compare its efficacy with low effector function or as effector function enabled molecule, respectively. The anti-PDL1 AbW was generated in the same formats (mouse IgG1 and mouse IgG2A).

The efficacy studies were performed in Balb/c mice using the sub-cutaneous CT26 colon carcinoma model (ATCC, CRL-2638). Balb/c mice were supplied by Charles River UK at 6-8 weeks of age and >18 g and housed under specific pathogen-free conditions. A total of 1×10E5 CT26 cells (passage number below P20) were subcutaneously injected into the right flanks of mice. Unless stated otherwise, treatment were initiated at day 6 post tumour cells injection. The CT26 cells were passaged in vitro by using TrypLE™ Express Enzyme (Thermofisher), washed twice in PBS and resuspended in RPMI supplemented with 10% foetal calf serum. Cell viability was confirmed to be above 90% at the time of tumour cell injection.

STIM001 and anti-PDL1 antibodies were dosed concurrently in combinations intraperitoneal (IP) at 200 μg each (1 mg/ml in 0.9% saline) three times a week from day 6 (dosing for 2 weeks between day 6-17) post tumour cell implantation. Tumour growth was monitored and compared to tumours of animals treated with a mixture of isotype control antibodies (mIgG1 and mIgG2A). Animal weight and tumour volume were measured 3 times a week from the day of tumour cell injection. Tumour volume was calculated by use of the modified ellipsoid formula 1/2(Length×Width2). Mice were kept on studies until their tumour reached an average diameter of 12 mm3 or, in rare case, when incidence of tumour ulceration was observed (welfare). The experiment was stopped at day 60. The human endpoint survival statistics were calculated using the Kaplan-Meier method with Prism. This approach was used to determine if specific treatments were associated with improved survival.

TABLE E11-2

Treatment groups for STIM001 2 × 2 combinations

| Group | Number of animals | Treatment regimen (3 time a week for 2 weeks) |
|---|---|---|
| 1 | 10 | mIgG2a + mIgG1 isotypes 200 μg each |
| 2 | 10 | Anti-ICOS mIgG1 STIM001 + Anti-PD-L1 mIGg1 (AbW) 200 μg each |
| 3 | 10 | Anti-ICOS mIgG2a STIM001 + Anti-PD-L1 mIGg2a (AbW) 200 μg each |
| 4 | 10 | Anti-ICOS mIgG2a STIM001 + Anti-PD-L1 mIGg1 (AbW) 200 μg each |
| 5 | 10 | Anti-ICOS mIgG1 STIM001 + Anti-PD-L1 mIGg2a (AbW) 200 μg each |

Figure 10:
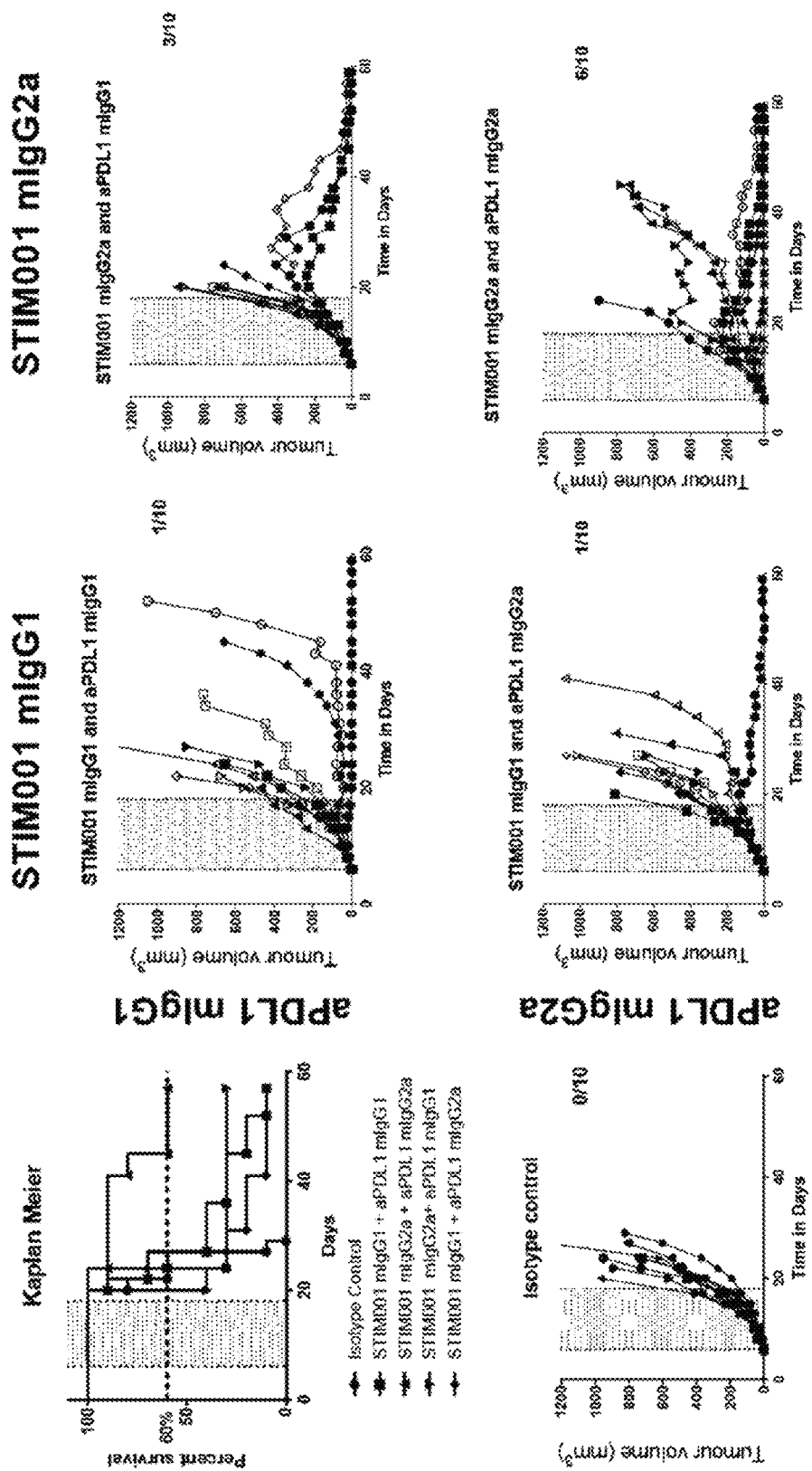
FIG. 10: 2×2 combinations CT26 in vivo efficacy study. Each treatment groups is represented by a "spider plot" showing the tumour size of individual animals (n=10 per groups). When combined with anti-PDL1 antibodies, STIM001 delays tumour growth and improves the survival of treated animals. The efficacy observed in the presence of STIM001 mIgG2a is superior to that of STIM001 mIgG1. Finally, STIM001 mIgG2a in combination with anti-PDL1 mIgG2a was the most potent combination to trigger the anti-tumour response resulting in 60% of the animals cured of the disease. For each group, the number of animals cured of their disease is indicated on the top right of the respective graphs. Dosing was on days 6, 8, 10, 13, 15 and 17.
Figure 11A:
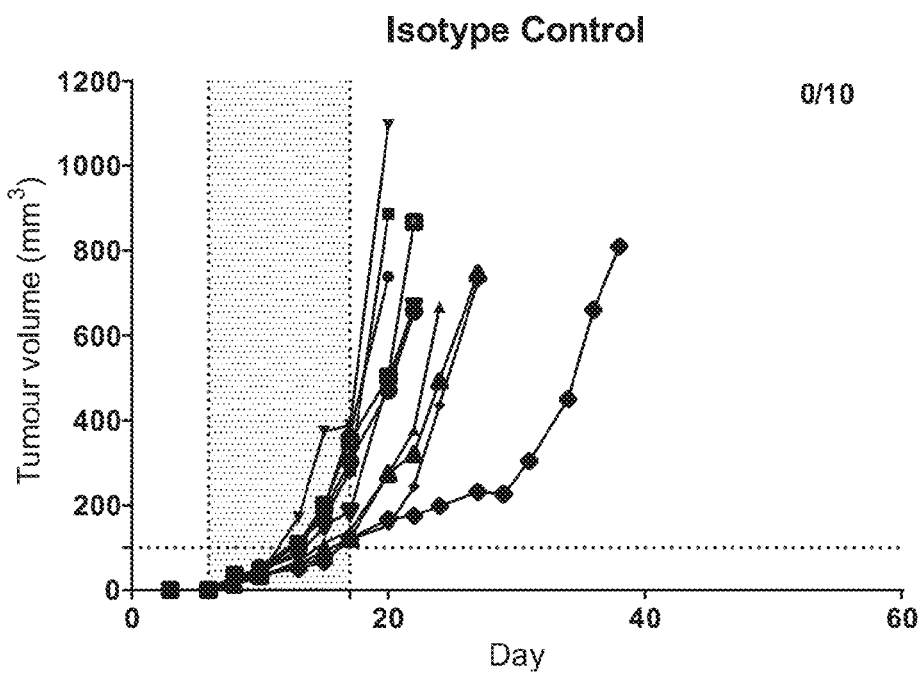
FIG. 11A, FIG. 11B, FIG. 11C, FIG. 11D, FIG. 11E, and FIG. 11F: Graphs showing the CT26 tumour volumes over time of animals treated with anti-ICOS or anti-PDL1 monotherapies or combination therapies. Each treatment group is represented by a "spider plot" showing the tumour size of individual animals (n=10 per group). For each group, the number of animals with tumour size below 100 mm^3 (stable/cured of their disease) is indicated on the top right of the respective graphs. Dosing was performed on days 6, 8, 10, 13, 15 and 17. Dosing time is indicated by the shaded area.
Figure 11B:
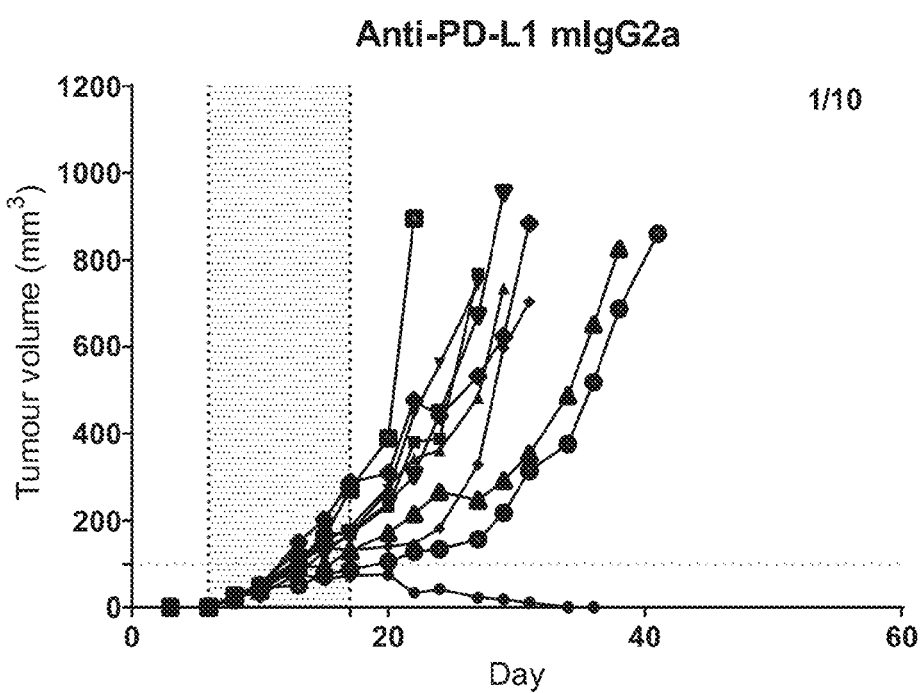
Figure 11C:
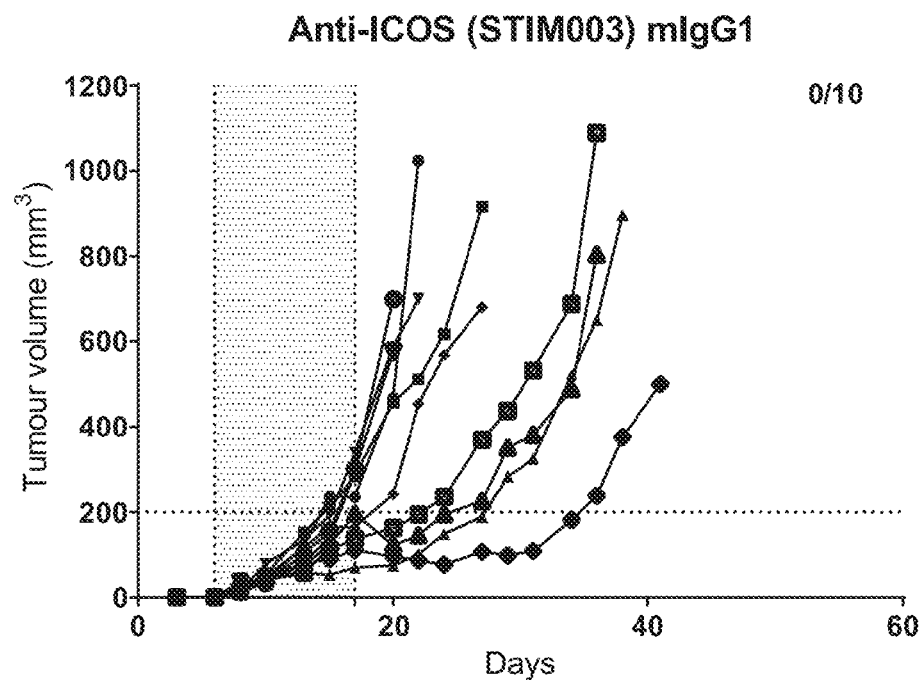
Figure 11D:
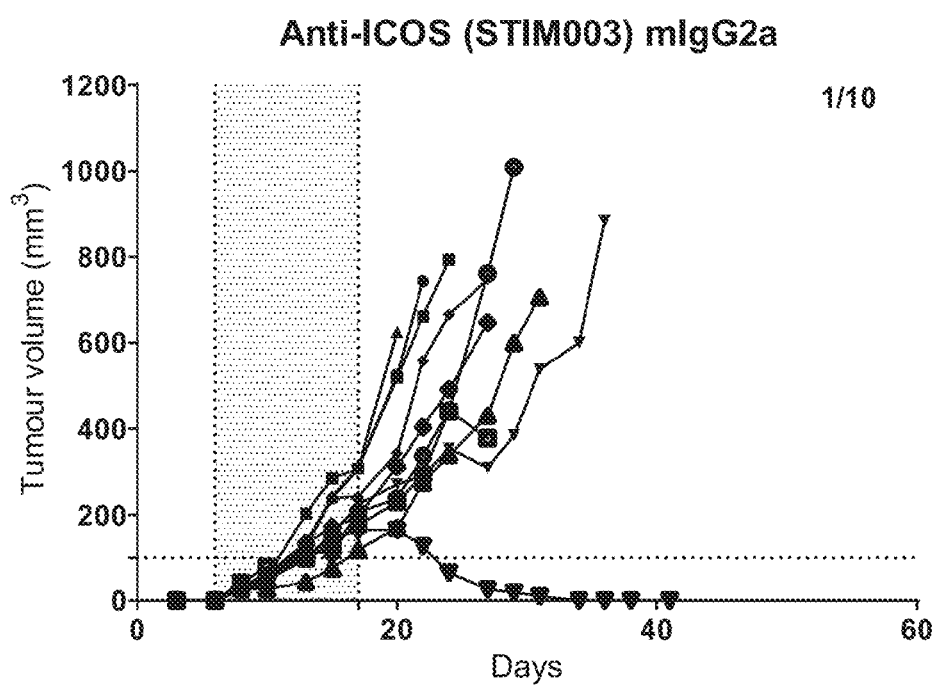
Figure 11E:
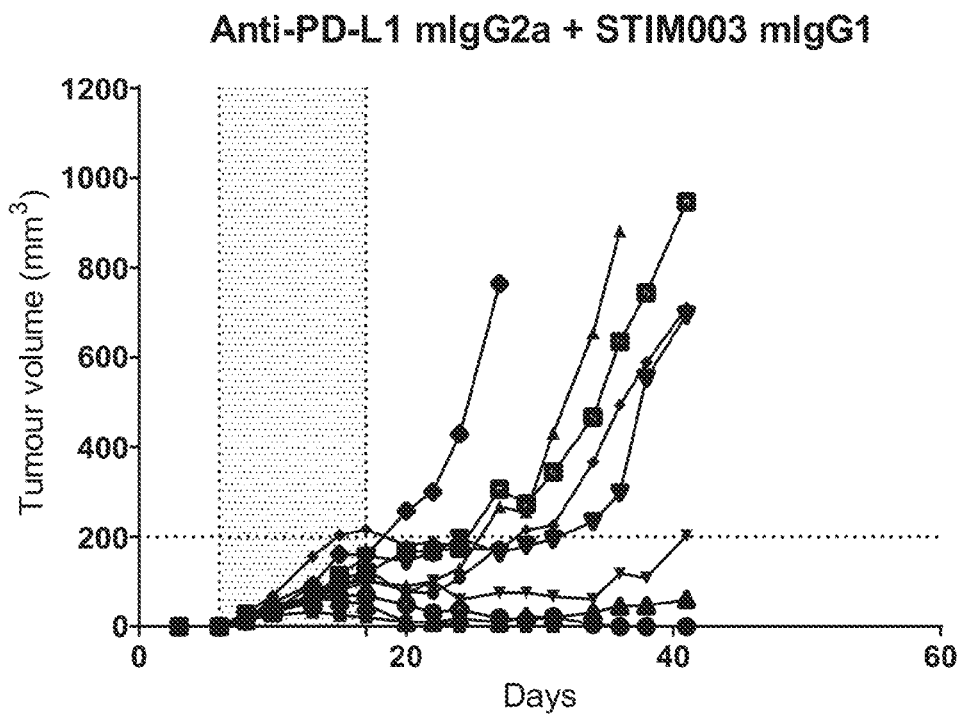
Figure 11F:
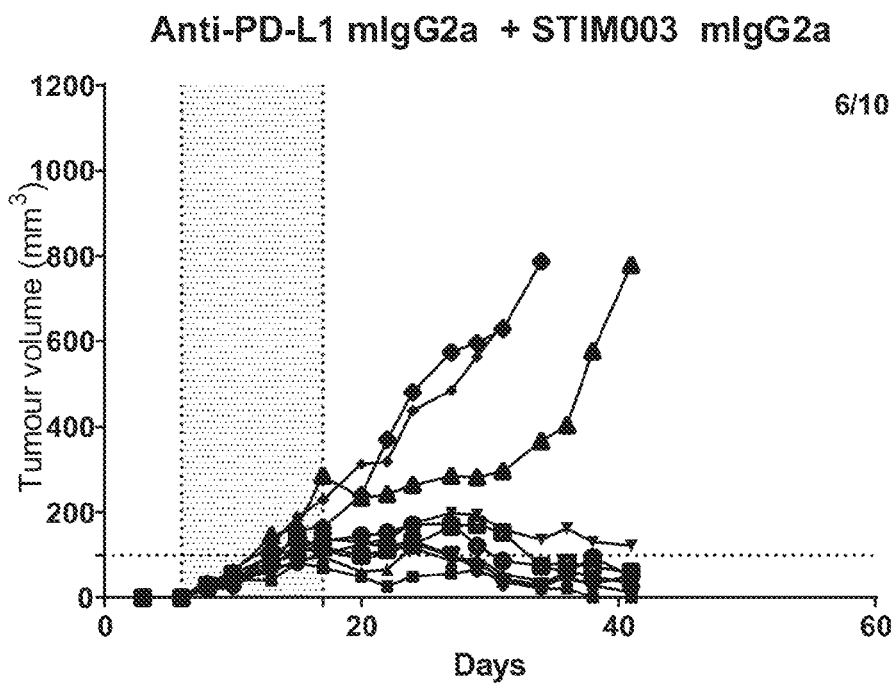

Results are shown in FIG. 10. All antibody combinations delayed tumour growth and extended the survival (time to reach human endpoint) of treated animals when compared to isotype control-treated animals. Interestingly, when combined with anti-PDL1 (independently of its format, mIgG1 or mIgG2a), STIM001 mIgG2a antibody was more effective at inhibiting tumour growth than STIM001 in the mIgG1 format. These data suggest the advantage of an anti-ICOS antibody having effector function to maximize anti-tumour efficacy. Notably, STIM001 mIgG2a in combination with aPD-L1 mIgG2a demonstrated the strongest anti-tumour efficacy and improved survival (90% of animals to show response and 60% were cured from the disease at day 60).

Similarly, STIM003 mIgG1 and mIgG2a were tested as monotherapy or in combination with anti-PDL1 (AbW) mIgG2a in the same CT26 tumour models. STIM003 and anti-PDL1 antibodies were dosed in animals as monotherapy or in combination by intraperitoneal injection (IP) of 200 μg of antibodies each (1 mg/ml in 0.9% saline) three times a week from day 6 (dosing for 2 weeks between day 6-17) post tumour cell implantation. In this experiment tumour sizes were monitored for 41 days. The human endpoint survival statistics were calculated using the Kaplan-Meier method with Prism. This approach was used to determine if specific treatments were associated with improved survival.

TABLE E11-3

Treatment groups for STIM003 combination with anti-PDL1 AbW IgG2a

| Group | Number of animals | Treatment regimen (3 times a week for 2 weeks from day 6) |
|---|---|---|
| 1 | 10 | mIgG2a + mIgG1 isotypes control 200 μg each |
| 2 | 10 | Anti-PD-L1 mIgG2a (AbW) 200 μg |
| 3 | 10 | STIM003 mIgG1 200 μg |
| 4 | 10 | STIM003 mIgG2a 200 μg |
| 5 | 10 | STIM003 mIgG1 + Anti-PD-L1 mIGg2a (AbW) 200 μg each |

TABLE E11-3-continued

Treatment groups for STIM003 combination with anti-PDL1 AbW IgG2a

| Group | Number of animals | Treatment regimen (3 times a week for 2 weeks from day 6) |
|---|---|---|
| 6 | 10 | STIM003 mIgG2a + Anti-PD-L1 mIGg2a (AbW) 200 μg each |

Results are shown in FIG. 11. Monotherapies using aPDL1 (AbW) and STIM003 mIgG2a demonstrated mild anti-tumour activity (one animal was cured of the disease in each group). Combinations of STIM003 mIgG1 or mIgG2a with aPDL1 (AbW) mIgG2a showed strong anti-tumour efficacy. Interestingly, by day 41, when combined with aPDL1 mIgG2a, STIM003 mIgG2a was more potent at inhibiting tumour growth than STIM003 mIgG1 (60% vs 30% of animals cured of the disease, respectively). The data further highlighted the advantage of an effector format for anti-ICOS antibodies to maximize anti-tumour efficacy.

Altogether, these data demonstrate that combination of an anti-ICOS antibody STIM001 or STIM003 with anti-PDL1 results in the strongest anti-tumour response when both antibodies have an effector enabled function. Suitable corresponding human antibody isotypes would include human IgG1, optionally with further enhanced effector function e.g., afucosylated IgG1.

Figure 29:
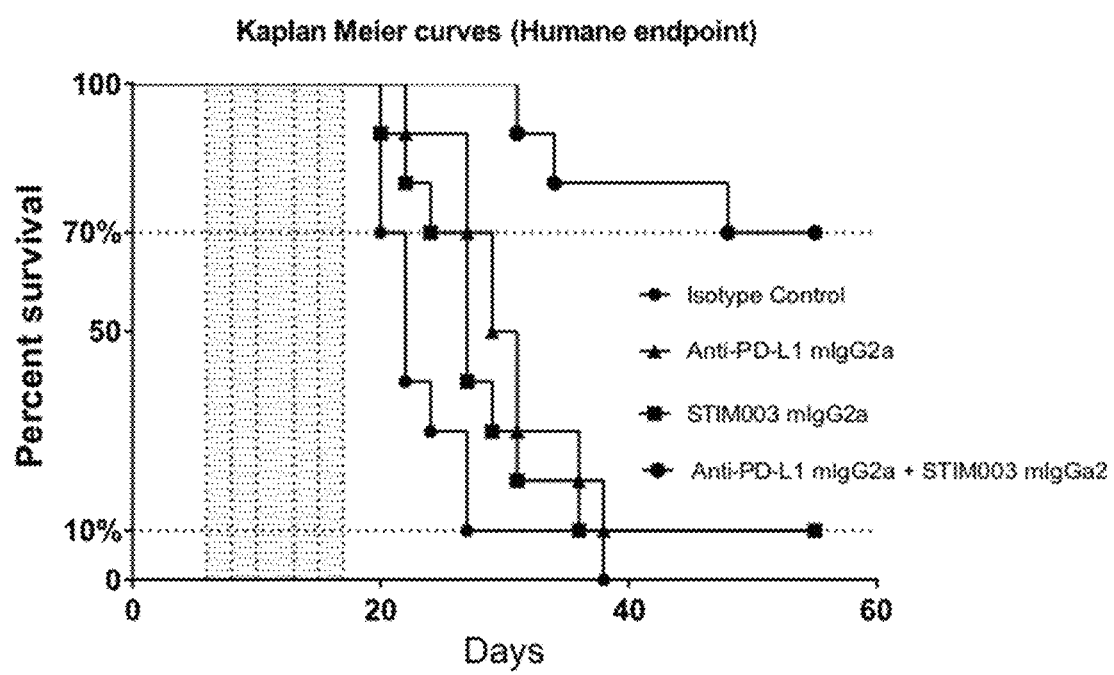
FIG. 29: Kaplan Meier curves for CT26 Balb/C model. Shading shows dosing window. LogRank p<0.0001.

Kaplan Meier curves for mice treated with the combination of anti-PDL1 mIgG2a and STIM003 mIgG2a and for each agent individually are shown in FIG. 29.

Example 11c: Single Dose of STIM003 Antibody Resets the Tumour Microenvironment (TME) and Results in Strong Anti-Tumour Efficacy in Combination with Continuous Anti-PD-L1 Dosing This study compared single vs multiple dosing of STIM003 mIgG2A together with multiple dosing of anti-PDL1 antibody (AbW). The data indicate that a single dose of anti-ICOS antibody could alter the tumour microenvironment so as to allow an anti-PD-L1 antibody to exert a greater effect. This can be envisaged as a "resetting" of the TME by the anti-ICOS antibody.

As before, these efficacy studies were performed in Balb/c mice using the sub-cutaneous CT26 colon carcinoma model (ATCC, CRL-2638). Balb/c mice were supplied by Charles River UK at 6-8 weeks of age and >18 g and housed under specific pathogen-free conditions. A total of 1×10E5 CT26 cells (passage number below P20) were subcutaneously injected into the right flanks of mice. Unless stated otherwise, treatments were initiated at day 6 post tumour cells injection. The CT26 cells were passaged in vitro by using TrypLE™ Express Enzyme (Thermofisher), washed twice in PBS and resuspended in RPMI supplemented with 10% foetal calf serum. Cell viability was confirmed to be above 90% at the time of tumour cell injection.

Treatment groups are shown in Table E11-4. STIM003 and anti-PDL1 antibodies were dosed intraperitoneal (IP) at 10 mg/kg (1 mg/ml in 0.9% saline). Treatments were initiated from day 6 post tumour cell implantation. Tumour growth was monitored and compared with tumours of animals treated with saline. Animal weight and tumour volume were measured 3 times a week from the day of tumour cell injection. Tumour volume was calculated by use of the modified ellipsoid formula 1/2(Length×Width2). Mice were kept on studies until their tumour reached an average diameter of 12 mm$^3$ or, in rare case, when incidence of tumour ulceration was observed (welfare). The experiment was stopped at day 55.

Figure 34A:
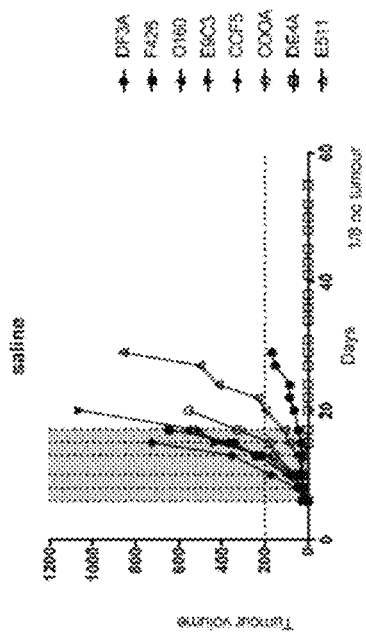
FIG. 34A, FIG. 34B, and FIG. 34C: Data from CT26 in vivo efficacy study described in Example 11c using combination of anti-PD-L1 mIgG2a antibody with single vs multiple doses of STIM003 mIgG2a. Each treatment group is represented by a "spider plot" showing the tumour size of individual animals (n=8 per group). For each group, the number of animals cured of their disease is indicated on the bottom right of the respective graph. Dosing days for each antibody are indicated by arrows below the respective graphs.
Figure 34C:
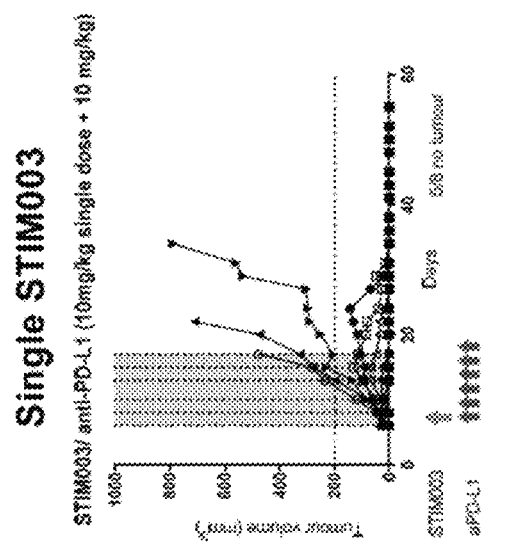
Figure 34B:
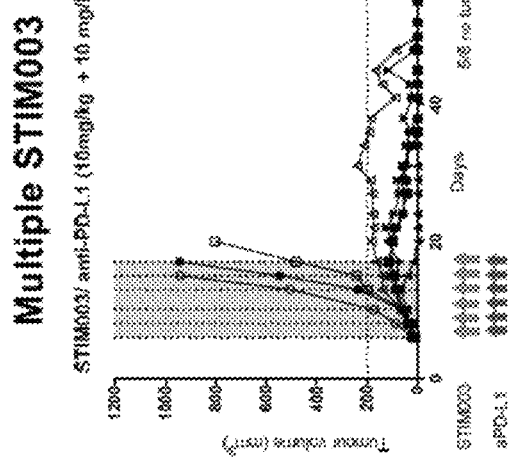

Data are shown in FIG. 34. Concurrent dosing of STIM003 and anti-PDL1 for 6 doses from day 6 resulted in a strong anti-tumour efficacy in the CT26 model with 5/8 animals being tumour free at the end of the study (day 55). Interestingly, similar anti-tumour efficacy was achieved with a single dose of STIM003 followed by multiple dose of anti-PDL1 as monotherapy. When combined with anti-PD-L1 mIgG2a, similar overall efficacy was observed between dosing STIM003 once (C) vs dosing 6 times (B). When compared with saline treated group (A) where only one animal had a spontaneous tumour rejection (rare in this model), the groups treated with combined drugs had full tumour rejection in 62.5% of the animals by the end of the experiment (day 55). The data suggest that the STIM003 antibody could be used to reset the tumour microenvironment and that the antibody allows immune-checkpoint resistant tumours to become sensitive to anti-PDL1. As previously shown (Example 11b), the CT26 tumour cell line is not strongly responsive to anti-PDL1 monotherapy. It appears that STIM003 causes changes that facilitate anti-tumour activity of the anti-PDL1 therapy.

Example 12: Antibody Sequence Analysis

Framework regions of antibodies STIM001, STIM002, STIM002-B, STIM003, STIM004, STIM005, STIM006, STIM007, STIM008 and STIM009 were compared with human germline gene segments to identify the closest match. See Table E12-1 and Table E12-2.

TABLE E12-1

Heavy chain germline gene segments of anti-ICOS Abs

| Heavy chain | V | D | J |
|---|---|---|---|
| STIM001 | IGHV1-18*01 | IGHD6-19*01 | IGHJ6*02 |
| STIM002 | IGHV1-18*01 | IGHD3-10*01 | IGHJ6*02 |
| STIM002-B | IGHV1-18*01 | IGHD3-10*01 | IGHJ6*02 |
| STIM003 | IGHV3-20*d01 | IGHD3-10*01 | IGHJ4*02 |
| STIM004 | IGHV3-20*d01 | IGHD3-10*01 | IGHJ4*02 |
| STIM005 | IGHV1-18*01 | IGHD3-9*01 | IGHJ3*02 |
| STIM006 | IGHV3-11*01 | IGHD3-10*01 | IGHJ6*02 |
| STIM007 | IGHV2-5*10 | IGHD3-10*01 | IGHJ6*02 |
| STIM008 | IGHV2-5*10 | IGHD3-10*01 | IGHJ6*02 |
| STIM009 | IGHV3-11*01 | IGHD3-9*01 | IGHJ6*02 |

TABLE E12-2

Kappa light chain germline gene segments of anti-ICOS Abs

| Light chain | V | J |
|---|---|---|
| STIM001 | IGKV2-28*01 | IGKJ4*01 |
| STIM002 | IGKV2-28*01 | IGKJ2*04 |
| STIM002-B | IGKV2-28*01 | IGKJ2*04 |
| STIM003 | IGKV3-20*01 | IGKJ3*01 |
| STIM004 | IGKV3-20*01 | IGKJ3*01 |
| STIM005 | IGKV1D-39*01 | IGKJ1*01 |
| STIM006 | IGKV2-28*01 | IGKJ2*04 |
| STIM007 | IGKV3-11*01 | IGKJ4*01 |
| STIM008 | IGKV3-11*01 | IGKJ4*01 |
| STIM009 | IGKV2-28*01 | IGKJ1*01 |

Additional antibody sequences were obtained by next generation sequencing of PCR-amplified antibody DNA from further ICOS-specific cells that were sorted from the immunised mice as described in Example 3. This identified a number of antibodies that could be grouped into clusters with STIM001, STIM002 or STIM003 based their heavy and light chain v and j gene segments and CDR3 length. CL-61091 clustered with STIM001; CL-64536, CL-64837, CL-64841 and CL-64912 clustered with STIM002; and CL-71642 and CL-74570 clustered with STIM003. Sequence alignments of the antibody VH and VL domains are shown in FIGS. 35 to 37.

MJ Cell Activation Assay Materials and Methods—Bead-Bound

Coupling Proteins of Interest to Magnetic Particles

Anti-ICOS antibodies, control antibodies, and ICOSL-Fc, were coupled to beads as follows.

TABLE E12-3

Antibodies clustered by sequence.

| ANTIBODIES | VH_V_GENE | VH_J_GENE | VH_CDR3_NT_LENGTH | VL_V_GENE | VL_J_GENE | VL_CDR3_NT_LENGTH |
|---|---|---|---|---|---|---|
| STIM001, CL-61091 | 1-18 | 6 | 42 | 2-28 | 4 | 27 |
| STIM002, CL-64536, CL-64837, CL-64841, CL-64912 | 1-18 | 6 | 51 | 2-28 | 2 | 27 |
| STIM003, CL-71642, CL-74570 | 3-20 | 4 | 51 | 3-20 | 3 | 27 |
| STIM004 | 3-20 | 4 | 51 | 3-20 | 3 | 24 |
| STIM005 | 1-18 | 3 | 51 | 1D-39 | 1 | 24 |
| STIM006 | 3-11 | 6 | 63 | 2-28 | 2 | 30 |
| STIM007, STIM008 | 2-5 | 6 | 48 | 3-11 | 4 | 27 |
| STIM009 | 3-11 | 6 | 60 | 2-28 | 1 | 27 |

Example 13: Monism of ICOS-Expressing MJ Cells by Bead-Bound Antibody

Antibodies STIM001, STIM002 and STIM003, the anti-ICOS antibody C398.4A, and ICOS ligand (ICOSL-Fc), were each covalently coupled to beads and assessed for their ability to induce expression of the cytokine IFN-γ from MJ cells grown in culture. Human IgG1 and Clone C398.4A isotype controls coupled to beads were assessed in parallel.

Figure 12:
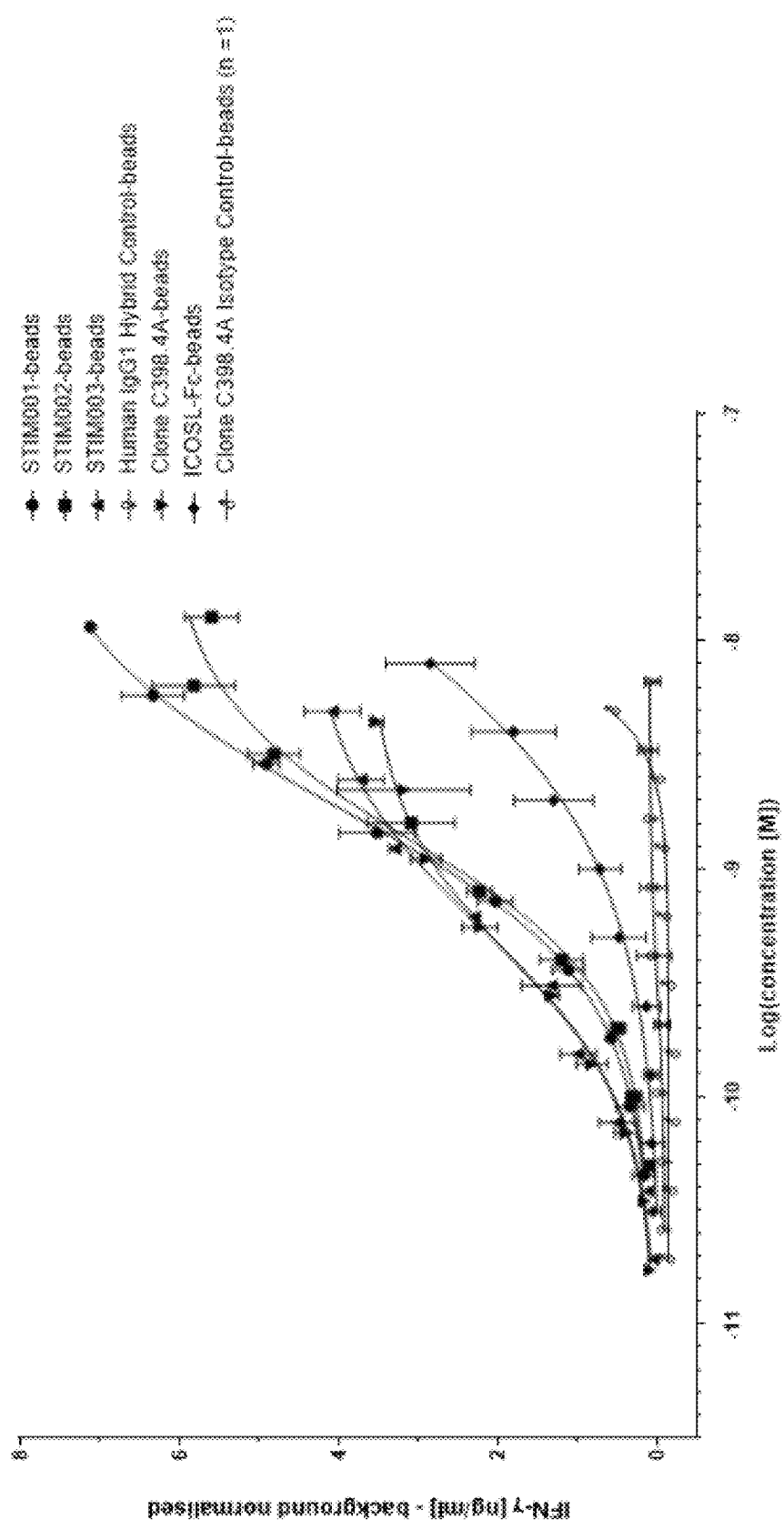
FIG. 12: MJ cell in vitro activation assay—bead bound. Stimulation profiles of STIM001, STIM002 and STIM003 anti-ICOS mAbs bound to beads compared with anti-ICOS C398.4A and respective isotype controls. Data represent the average of two experiments (n=1 in the case of C398.4A isotype control beads).

Data are shown in FIG. 12 and Table E13 below.

Each of the anti-ICOS antibodies demonstrated agonism in this assay, stimulating MJ cells as determined by IFN-γ quantification significantly above that observed by their cognate isotype controls within the dynamic range of the assay.

STIM003 and Clone C398.4A produced lower top asymptote values (95% CI: 3.79 to 5.13 and 3.07 to 4.22, respectively) but more potent Log EC50 values (95% CI: −9.40 to −9.11 and −9.56 to −9.23, respectively) compared with STIM001 (Top 95% CI: 7.21 to 8.88 and Log EC50 95% CI: −8.82 to −8.63) and STIM002 (Top 95% CI: 5.38 to 6.95 and Log EC50 95% CI: −9.00 to −8.74). Because incomplete curves (Top out of dynamic range of assay) were produced for ICOSL-Fc and Clone C398.4A isotype control, the fitted Top and Log EC50 values were not treated as reliable. Human IgG1 Hybrid Control produced a complete curve, however the area under the curve was not significantly different from 0 and it was therefore not deemed to be an agonist.

Dynabeads M-450 Tosylactivated (Invitrogen; approximately 2×10^8 beads/sample) were incubated with 100 μg of each protein sample overnight at room temperature with agitation. Beads were washed three times with DPBS (Gibco) and incubated with 1M Tris-HCl, pH 8.0 (Ultra-Pure™, Gibco) for 1 hr at room temperature with agitation to block the uncoupled reactive sites. Beads were washed again three times with DPBS and finally resuspended in 0.5 ml of DPBS/sample.

The quantity of each protein of interest on the beads was then determined as follows. Black flat bottom, high binding ELISA plates (Greiner) were coated with Anti-human IgG (Southern Biotech) or Anti-Armenian Hamster IgG (Jackson ImmunoResearch) capture antibody at 4 μg/ml in DPBS, 50 μl/well, overnight at 4° C. Wells were then washed three times with DPBS+0.1% Tween, 200 μl/well and blocked with 200 μl/well of DPBS+1% BSA for 1 hr at RT. Wells were washed again three times with DPBS+0.1% Tween. Stock protein samples were quantified spectrometrically and beads were counted on a cell counter. Dilution series of protein samples and beads were then incubated in the plates at 50 μl/well for 1 hr at RT before washing again three times with DPBS+0.1% Tween. 50 μl/well of either biotinylated anti-armenian hamster antibody or anti-human IgG—europium in DPBS+0.1% BSA were added and incubated for 1 hr at RT. In the case of addition of biotinylated anti-Armenian hamster antibody C398.4A another incubation step with 50 μl/well of streptavidin-europium (Perkin Elmer) diluted 1:500 in Assay buffer (Perkin Elmer) were added and

TABLE E13

Summary table of bead bound MJ cell in vitro activation assay.

| Best-fit values 95% CI | STIM001-beads | STIM002-beads | STIM003-beads | Human IgG1 Hybrid Control-beads | Clone C398.4A-beads | Clone C398.4AIC-beads | ICOSL-Fc-beads |
|---|---|---|---|---|---|---|---|
| Bottom | −0.24 to 0.36 | −0.38 to 0.56 | −0.39 to 0.34 | −0.26 to 0.06 | −0.37 to 0.42 | −0.20 to −0.09 | −0.62 to 0.49 |
| Top | 7.21 to 8.88 | 5.38 to 6.95 | 3.79 to 5.13 | −0.04 to 0.20 | 3.07 to 4.22 | NA | −45.66 to 65.37 |
| LogEC50 | −8.82 to −8.63 | −9.00 to −8.74 | −9.40 to −9.11 | −10.43 to −8.60 | −9.56 to −9.23 | NA | −12.80 to −2.37 |
| HillSlope | 0.89 to 1.38 | 0.82 to 1.85 | 0.69 to 1.56 | −3.47 to 6.61 | 0.64 to 1.90 | NA | −0.38 to 1.88 |

NA—not applicable.

incubated for 1 hr at RT. The wells were washed three times with 200 μl/well of TBS+0.1% Tween before developing the assay by adding 50 μl/well of Delfia enhancement solution (Perkin Elmer), incubating for 10 mins at RT and measuring the fluorescence emitted at 615 nm on the EnVision Multi-label Plate Reader. The quantity of protein on the beads was determined by extrapolating values from the signals obtained from known concentrations of uncoupled protein samples.

MJ Cell In Vitro Activation Assay—Bead Bound

MJ [G11] cell line (ATCC CRL-8294) was grown in IMDM (Gibco or ATCC) supplemented with 20% heat inactivated FBS. Cells were counted and 15000 cells/well (50 μl/well) of cell suspension was added to 96-well clear flat bottom polystyrene sterile TC-treated microplates. Beads were counted and serial 1:2 dilutions ranging from 1.5×10^6 beads/well to approximately 5860 beads/well (50 μl/well) were added to the cells in duplicate or in triplicate. To account for background several wells of the plate contained MJ cells only (100 μl/well). The cells and beads were co-cultured in the plates for 3 days at 37° C. and 5% $CO_2$ after which supernatants were harvested by centrifugation and collected for IFN-γ content determination.

Measuring IFN-γ Levels

The IFN-γ content in each well was determined using a modification of the Human IFNgamma DuoSet ELISA kit (R&D systems). Capture antibody (50 μl/well) was coated overnight at 4 μg/ml in DPBS on black flat bottom, high binding plates (Greiner). The wells were washed three times with 200 μl/well of DPBS+0.1% Tween. The wells were blocked with 200 μl/well of 1% BSA in DPBS (w/v), washed three times with 200 μl/well of DPBS+0.1% Tween and then 50 μl/well of either the IFN-γ standard solutions in RPMI or neat cell supernatant were added to each well and incubated for 1 hr at RT. The wells were washed three times with 200 μl/well of DPBS+0.1% Tween before adding 50 μl/well of biotinylated detection antibody at 200 ng/ml in DPBS+0.1% BSA and incubated for 1 hr at RT. The wells were washed three times with 200 μl/well of DPBS+0.1% Tween before adding 50 μl/well of streptavidin-europium (Perkin Elmer) diluted 1:500 in Assay buffer (Perkin Elmer) and incubated for 1 hr at RT. The wells were washed three times with 200 μl/well of TBS+0.1% Tween before developing the assay by adding 50 μl/well of Delfia enhancement solution (Perkin Elmer) and incubating for 10 mins at RT and measuring the fluorescence emitted at 615 nm on the EnVision Multilabel Plate Reader.

Data Analysis

IFN-γ values for each well were interpolated from the standard curve and the average background levels from cell-only wells were subtracted. The background corrected values were then used in GraphPad prism to fit a 4-parameter log-logistic concentration response curve.

Example 14: Monism of ICOS-Expressing MJ Cells by Plate-Bound Antibody

An alternative assay for agonism of ICOS-expressing T cells uses antibodies in a plate-bound format.

MJ Cell Activation Assay Materials and Methods—Plate-Bound

Antibody coating: 96-well, sterile, flat, high binding plates (Costar) were coated overnight at 4° C. with 100 μl/well of serial 1:2 dilutions of proteins of interest (anti-ICOS antibodies, control antibodies, and ICOSL-Fc) in DPBS (Gibco) ranging from 10 μg/ml to 0.02 μg/ml of in duplicate or in triplicate. To account for background several wells of the plate were coated with DPBS only. Plates were then washed three times with 200 μl/well of DPBS before the addition of cells.

Cell stimulation: MJ [G11] cell line (ATCC CRL-8294) was grown in IMDM (Gibco or ATCC) supplemented with 20% heat inactivated FBS. The cells were counted and 15000 cells/well (100 μl/well) of cell suspension were added to the protein coated plates. Cells were cultured in the plates for 3 days at 37° C. and 5% $CO_2$. Cells were separated from the media by centrifugation and the supernatants collected for IFN-γ content determination.

Measurement of IFNγ levels and data analysis was as described in Example 13.

Results

Figure 13:
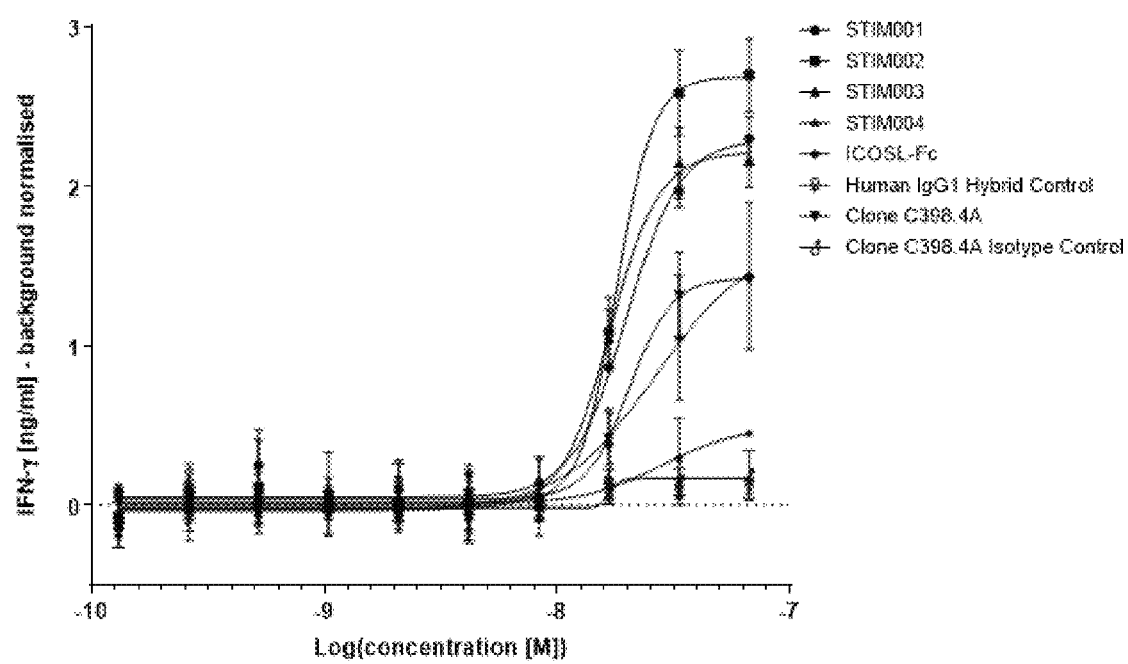
FIG. 13: MJ cell in vitro activation assay—plate bound. Stimulation profiles of plate-bound STIM001, STIM002, STIM003 and STIM004 anti-ICOS mAbs compared with anti-ICOS C398.4A and respective isotype controls. Data represent the average of two experiments.

Results are shown in FIG. 13 and in Table E14-1 below. In summary, STIM001, STIM002 and STIM003 all showed potent agonism as measured by IFN-γ secretion with similar Log EC50 values (Log EC50 95% CI: −7.76 to −7.64, −7.79 to −7.70 and −7.82 to −7.73, respectively) and Top values (Top 95% CI: 2.06 to 2.54, 2.44 to 2.93 and 2.01 to 2.41, respectively). Clone C398.4A exhibited a similar Log EC50 value (Log EC50 95% CI: −7.78 to −7.60) but lower Top value (Top 95% CI: 1.22 to 1.63) than STIM001 to STIM003. STIM004 also showed agonism in this assay, but was less potent, reaching a moderate Top value (Top 95% CI: 0.16 to 0.82) with a similar Log EC50 value (Log EC50 95% CI: −7.91 to −7.21). STIM001, STIM002 and STIM003 were stronger agonists than ICOSL-Fc (Log EC50 95% CI: −7.85 to −7.31 and Top 95% CI: 0.87 to 2.45).

TABLE E14-1

Summary of plate-bound MJ cell in vitro activation assay.

| Best-fit values 95% CI | STIM001 | STIM002 | STIM003 | STIM004 | IgG1 | Clone C398.4A | ICOSL-Fc | Clone C398.4A IC |
|---|---|---|---|---|---|---|---|---|
| Bottom | −0.03 to 0.13 | −0.08 to 0.11 | −0.10 to 0.07 | −0.06 to 0.07 | NA | −0.03 to 0.11 | −0.16 to 0.09 | −0.07 to 0.04 |
| Top | 2.06 to 2.54 | 2.44 to 2.93 | 2.01 to 2.41 | 0.16 to 0.82 | NA | 1.22 to 1.63 | 0.87 to 2.45 | 0.05 to 0.29 |
| LogEC50 | −7.76 to −7.64 | −7.79 to −7.70 | −7.82 to −7.73 | −7.91 to −7.21 | NA | −7.78 to −7.60 | −7.85 to −7.31 | NA |
| HillSlope | 2.06 to 5.38 | 0.16 to 10.88 | 1.77 to 6.5 | −1.46 to 6.77 | NA | 1.24 to 8.20 | 0.26 to 3.97 | NA |

IgG1 = Human IgG1 hybrid control antibody.

Example 15: Monism of ICOS-Expressing MJ Cells by Antibody in Soluble Form

In contrast to the assays described in Example 13 and Example 14, which used antibody arrayed on a solid surface, this assay determines whether antibody in soluble form acts as agonist of ICOS-expressing T cells.

MJ Cell Activation Assay Materials and Methods—Soluble

MJ [G11] cell line (ATCC CRL-8294) was grown in IMDM (Gibco or ATCC) supplemented with 20% heat inactivated FBS. Cells were counted and 15000 cells/well (50 µl/well) of cell suspension was added to 96-well clear flat bottom polystyrene sterile TC-treated microplates. Serial 1:2 dilutions of proteins of interest ranging from 10 µg/ml to 0.01953125 µg/ml either alone or with the addition of a cross-linking reagent (AffiniPure F(ab')2 Fragment Goat Anti-Human IgG, Fc Fragment Specific; Jackson ImmunoResearch) were added to the cells in duplicate or in triplicate (50 µl/well). To account for background several wells of the plate contained MJ cells only (100 µl/well). The cells and beads were co-cultured in the plates for 3 days at 37° C. and 5% $CO_2$ after which supernatants were harvested by centrifugation and collected for IFN-γ content determination.

Measurement of IFNγ levels and data analysis was as described in Example 13.

Results

STIM001 and STIM002 both showed significant soluble agonism as measured by IFN-γ secretion compared to Human IgG4.PE hybrid control. MAb cross-linking via Goat Anti-Human IgG Fc F(ab')2 Fragment increased secreted IFN-γ levels even more.

Example 16: Binding of Antibody to Activated T Cells

A. Human ICOS

Ability of anti-ICOS antibodies to recognise the ICOS extracellular domain in its native context on the surface of activated primary human T cells is confirmed in this assay.

Pan T-cells (CD3 cells) were isolated and cultured for 3 days with CD3/CD28 dynabeads (Thermofisher) to induce ICOS expression on their surface. Surface staining of STIM001, STIM003 and the hIgG1 hybrid control (HC IgG1) was determined by two methods, namely detection following direct binding of pre-labelled antibodies (antibodies directly conjugated with AF647) or indirectly via the use of a secondary AF647-Goat anti-human Fc antibody. Stained cells were ran on the Attune and staining intensity was presented as Mean of fluorescence intensity (MFI). EC50 was determined using GraphPad Prism.

Figure 14:
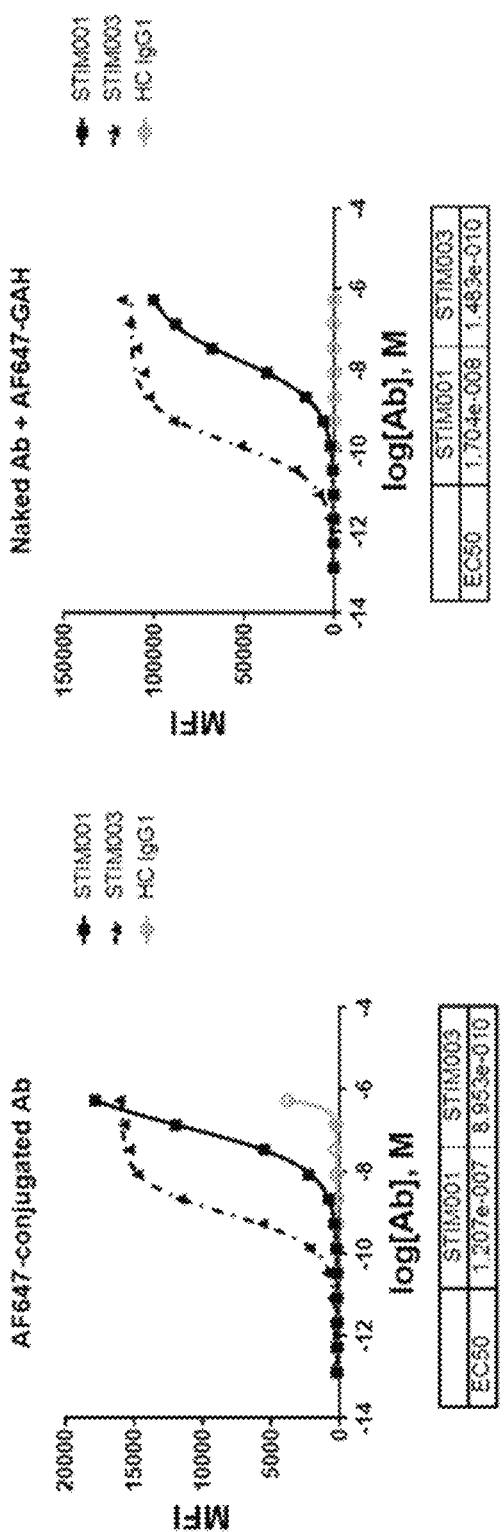
FIG. 14: FACS analysis of STIM001 and STIM003 hIgG1 binding to activated T cells. (a) shows a representative experiment of the dose response of pre-labelled antibodies binding to activated T cells, whereas (b) shows the binding following the dose response of naked antibodies followed by the detection with a secondary labelled antibody. Tables indicate relevant EC50 (M) as determined using GraphPad Prism.

Results are shown in FIG. 14. Once activated, pan CD3 T cells were clearly stained by both STIM001 and STIM003 hIgG1. Notably, the saturation of STIM003 binding to activated T cells occurred at a lower concentration than that of STIM001, suggesting higher affinity of STIM003 to human ICOS. The EC50 of STIM003 was roughly 100× lower than that of STIM001 (0.148 nM vs 17 nM for the indirect binding assay).

B. ICOS from Non-Human Primates

Ability of anti-ICOS antibodies to recognise the ICOS extracellular domain in its native context on the surface of activated primary T cells from non-human primates (NHP) is confirmed in this assay.

PBMC from whole blood of 2 Mauritian cynomolgus macaques (Wickham Laboratories) were isolated by gradient centrifugation and cultured for 3 days with CD2/CD3/CD28 MACSiBeads (Miltenyi) to induce ICOS expression on their surface. Surface staining of STIM001, STIM003 and the hIgG1 hybrid control (HC IgG1) was determined following direct binding of AF647 pre-labelled antibodies (from 80 µg to 8 pg/ml). Cells were also labelled with V450-CD3 to assess staining on T-cell subsets. Stained cells were run on Attune (Thermofisher) and staining intensity was presented as mean fluorescence intensity (MFI). EC50 was determined using GraphPad Prism.

Figure 28A:
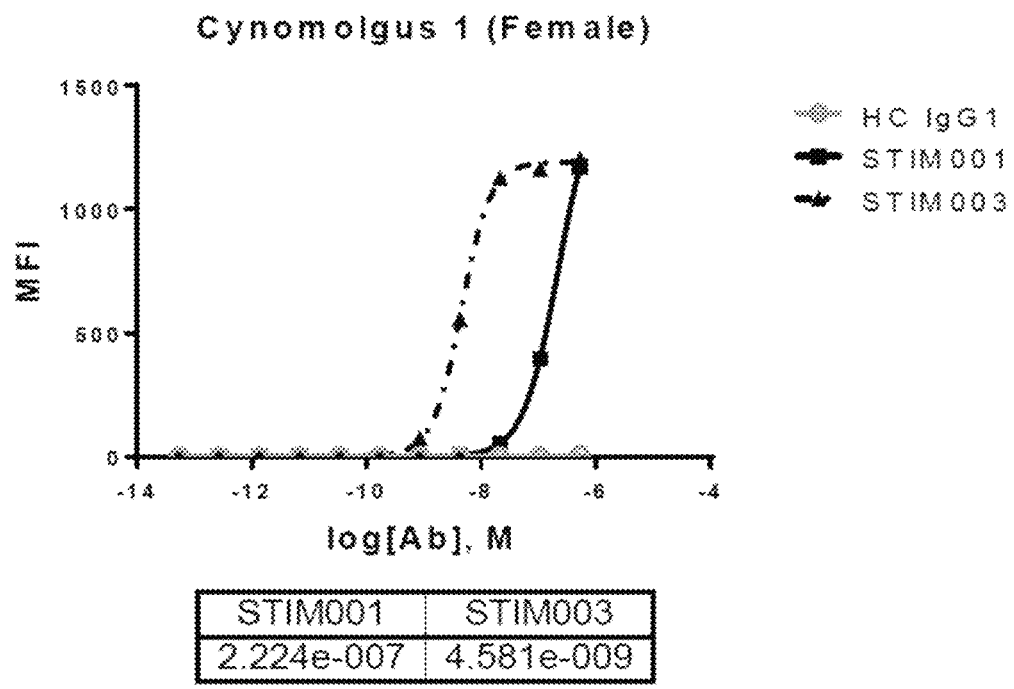
FIG. 28A and FIG. 28B: Surface staining of AF647-conjugated STIM001, STIM003 and hIgG1 hybrid control (HC IgG1) on activated Mauritian cynomolgus pan T cells. Data from assays using different donor sources of T cells are shown in FIG. 28A and FIG. 28B respectively. EC50 values are indicated in the table.
Figure 28B:
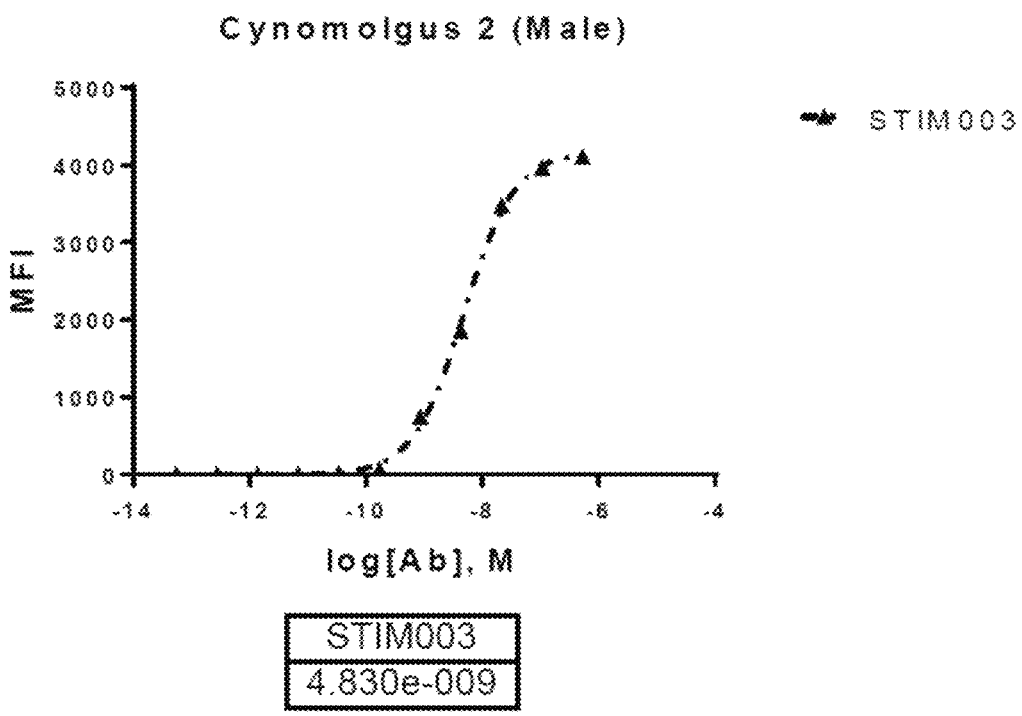

Results are shown in FIG. 28. Once activated, T cells were clearly stained by both STIM001 and STIM003 hIgG1. As was observed with binding to human T cells, saturation of STIM003 binding to activated NHP T cells occurred at lower concentration than that of STIM001, indicating that STIM0003 has the higher affinity of these two antibodies ICOS. EC50 values for binding to NHP ICOS were similar to those obtained for binding to human ICOS.

TABLE E16

EC50 (Molar) calculated for antibody binding to ICOS on activated NHP T cells

| Pan T-cells | EC50 | Cynomolgus donor 1 | Cynomolgus donor 2 |
|---|---|---|---|
| NHP | STIM001 | 2.224e−7 | not tested |
|  | STIM003 | 4.581e−9 | 4.830e−9 |
| Human | STIM001 | 2.209e−7 | 1.207e−7 |
|  | STIM003 | 2.293e−9 | 8.953e−10 |

Example 17: Analysis of T Cell Sub-Populations Among Tumour Infiltrating Lymphocytes and Peripheral T Cells A pharmacodynamics study revealed that anti-ICOS antibodies STIM001 and STIM003 in mIgG2a isotype significantly deplete TRegs, increase the percentage of CD4+ effector cells and increase the CD4+ effector/TReg ratio as well as the CD8+/TReg ratio within the tumour microenvironment (TME).

The increased CD8+/TReg ratio and increased number of CD4+ effector cells within the TME may collectively contribute to the CT26 tumour clearance observed when these anti-ICOS antibodies were co-injected with anti-PDL1 antibody in the STIM001 & STIM003 efficacy study (Example 11).

Method

The pharmacodynamics study was performed in female Balb/c mice bearing CT-26 mouse colon carcinoma cells (ATCC, CRL-2638). Balb/c mice were supplied by Charles River UK at 6-8 weeks of age and >18 g and housed under specific pathogen-free conditions. A total of 1×10E5 CT-26 tumour cells (passage number: P8) were subcutaneously injected in the right flank. All CT-26 tumour bearing animals were assigned to 6 groups (Table E17-1) and individual mice were dosed twice (on Day 13 & Day 15 post tumour cell implantation) with 200 µg of antibody or saline. CD3+ T-cells from the CT-26 tumour bearing animals were analysed by FACS on day 16 post tumour cell implantation.

TABLE E17-1

Treatment groups

| Group | Number of animals | Treatment regimen (Day 13 and Day 15 post tumour cell implantation) |
|---|---|---|
| 1 | 10 | Saline |
| 2 | 10 | Anti-ICOS (STIM001) mIgG1 200 µg each |
| 3 | 10 | Anti-ICOS (STIM001) mIgG2a 200 µg each |
| 4 | 10 | Anti-ICOS (STIM003) mIgG1 200 µg each |
| 5 | 10 | Anti-ICOS (STIM003) mIgG2a 200 µg each |
| 6 | 10 | Anti-CTLA-4 (9H10) 200 µg each |

Results

Figure 15A:
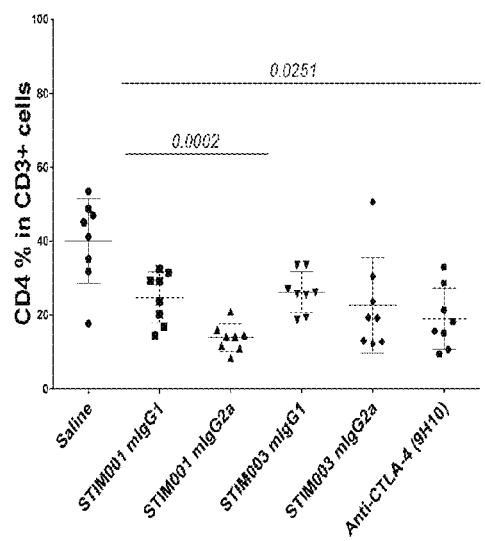
FIG. 15A, FIG. 15B, FIG. 15C, FIG. 15D, FIG. 15E, FIG. 15F, and FIG. 15G: STIM001 and STIM003 showed isotype-dependent effects on the T cell compartment at the tumour site. A total of 1×10E5 CT-26 tumour cells were implanted subcutaneously in Balb/c female mice. At day 13 and day 15 post implantation animals were dosed with antibodies or saline intraperitoneally (n=10/each group). On day 16 post implantation spleen and tumours were harvest from tumour bearing animals (n=8/each group), dissociated and stained for FACS analysis.
Figure 15B:
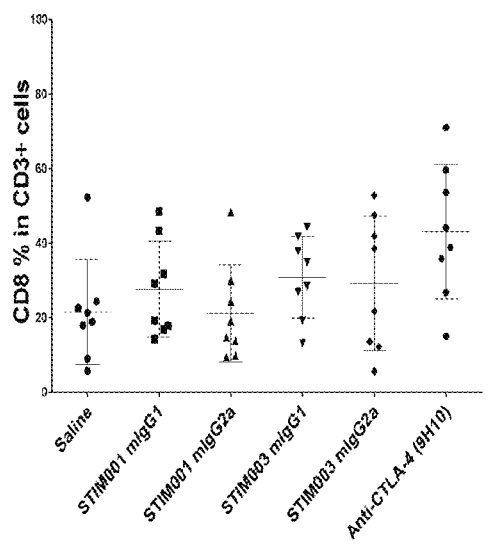
Figure 15C:
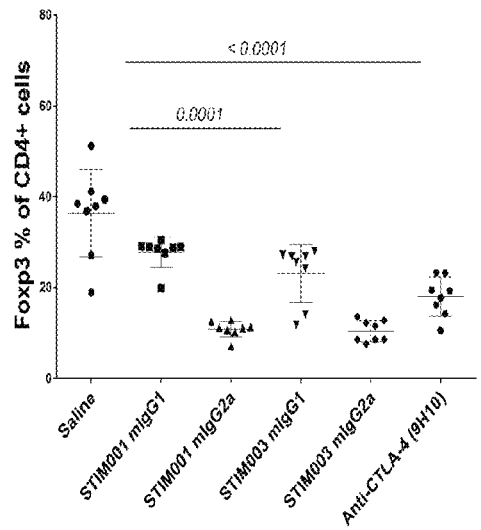
Figure 15D:
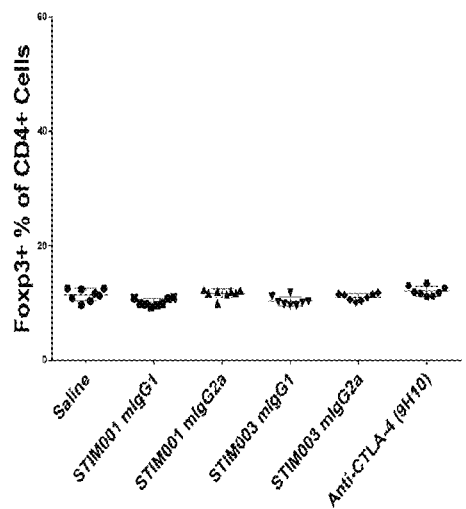
Figure 15E:
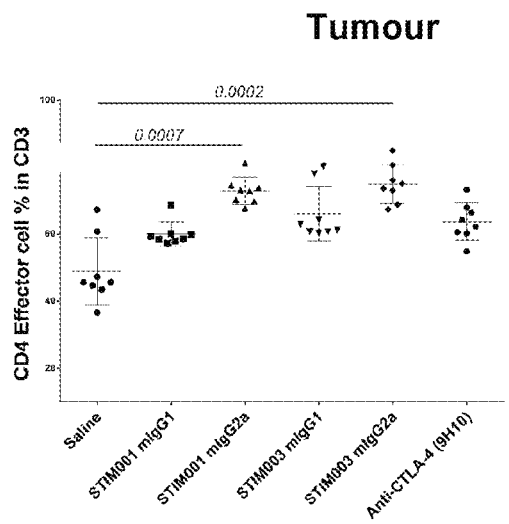
Figure 15F:
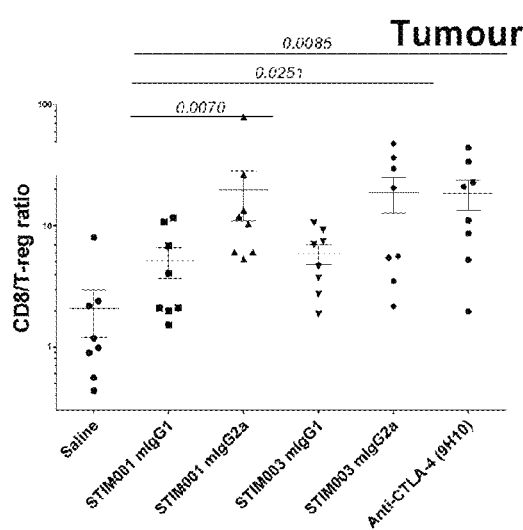
Figure 15G:
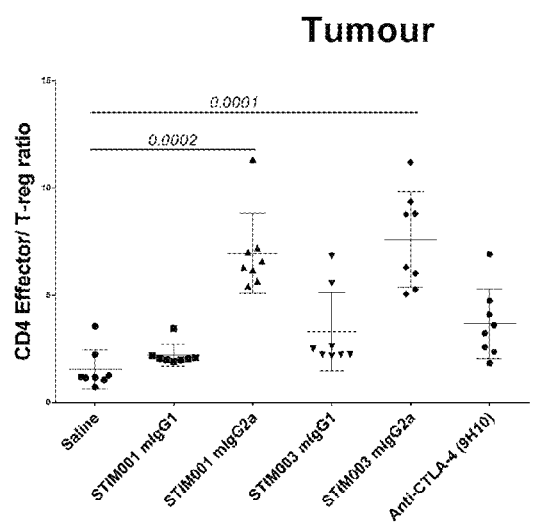

Animals treated with STIM001 & STIM003 in the mIgG2a isotype showed a lower percentage of CD4+ CD3+ CD45+ cells at the tumour site when compared with saline treated group (FIG. 15A), whereas STIM001 or STIM003 treatments had very marginal effect of the percentage of CD8+ CD3+ CD45+ cells at the tumour site (FIG. 15B). The decrease in CD4+ T cells could be attributed to a profound decrease in the percentages of T-Regulatory cells in all the groups treated with STIM001 and STIM003 antibodies. Notably, animals treated with STIM001 and STIM003 in the mIgG2a isotype showed a dramatic reduction in T-Regs (CD4+ Foxp3+ CD25+) within the TME, whereas STIM001 & STIM003 in the mIgG1 isotype had only a modest effect on T-Reg content in TME. In addition, animals treated with STIM001 & STIM003 in the mIgG2a isotype had reduced T-Reg in the TME when compared with the animals treated with a commercial anti-CTLA-4 (9H10, Biolegend Cat#106208) antibody which is known to deplete T-Reg [42], but this result did not reach statistical significance (FIG. 15C). The effect of STIM001 and STIM003 either in mIgG1 or mIgG2a isotypes on T-Reg compartment was more specific with tumour infiltrating lymphocytes (TILs). T-reg depletion was not observed in the periphery (as previously described for anti-CTLA4 [43]) (FIG. 15D). The changes in T-Reg contents also resulted in a significant increase in the percentage of intra-tumoural CD4-effector cells (CD4+ Foxp3− CD25−) (FIG. 15E), similarly the ratio of CD4 effector/T-Reg and CD8/T-Reg ratio in the animals treated with STIM001 & STIM003 in the mIgG2a was also significantly increased within TME (FIG. 15F & FIG. 15G).

Example 18: Effect of Anti-ICOS Antibody on Level of ICOS-Expressing T Cells in CT26 Tumour and Spleen Analysis was performed to quantify the percentage of immune cells within the tumour compared with the spleen, by analysis of total immune cells in the tumour and spleen tissues, following treatment with anti-ICOS antibody STIM001 or STIM003. STIM001 and STIM003 mIgG2a each caused a significant reduction in Treg within the tumour, but not in the spleen, indicating a tumour-selective effect. This depletion was selective for Tregs compared with other T cell subtypes. The results presented here assist in understanding the effects of the STIM antibodies on the immune contexture, and confirm that anti-ICOS antibodies with effector-function-enabled Fc regions can strongly deplete TRegs.

Materials and Methods

Mice bearing CT26 tumours were dosed twice with STIM001, STIM003, or anti-CTLA4 antibody (9H10). The anti-CTLA4 antibody was included as a positive control for Treg depletion, as anti-CTLA4 antibody had been previously shown to selectively reduce Tregs in tumours [43].

The immune contexture within the tumours and the spleen of treated animals was analysed by FACS following tissue disaggregation.

Details of FACS antibodies used in this study are shown in Table E18. All FACS antibodies were used at a concentration recommended by the supplier. FACS data were acquired using Attune NxT flow cytometer and data were analysed using FlowJo software.

TABLE E18

FACS antibodies.

| Marker | Supplier | Cat. number | Lot number | Fluorophore |
| --- | --- | --- | --- | --- |
| Live/dead | Life technologies | L-34959 | 1784156 | Fixable Yellow |
| CD45 | E-bioscience | 45-0451-82 | E08336-1636 | PerCp-Cy5.5 |

TABLE E18-continued

FACS antibodies.

| Marker | Supplier | Cat. number | Lot number | Fluorophore |
| --- | --- | --- | --- | --- |
| CD3 | E-bioscience | 48-0032-82 | 4278794 | eFlour 450 |
| CD4 | E-bioscience | 11-0042-86 | E0084-1633 | FITC |
| CD8 | E-bioscience | 12-0081-85 | E01039-1635 | PE |
| Foxp3 | E-bioscience | 17-5773-82 | 4291991 | APC |
| CD25 | E-bioscience | 47-0251-82 | 4277960 | APC eF 780 |
| ICOS | E-bioscience | 25-9942-82 | E17665-103 | PE-CY7 |
| Fc/Block | E-bioscience | 16-0161-86 | E06357-1633 | — |

Results

Figure 20:
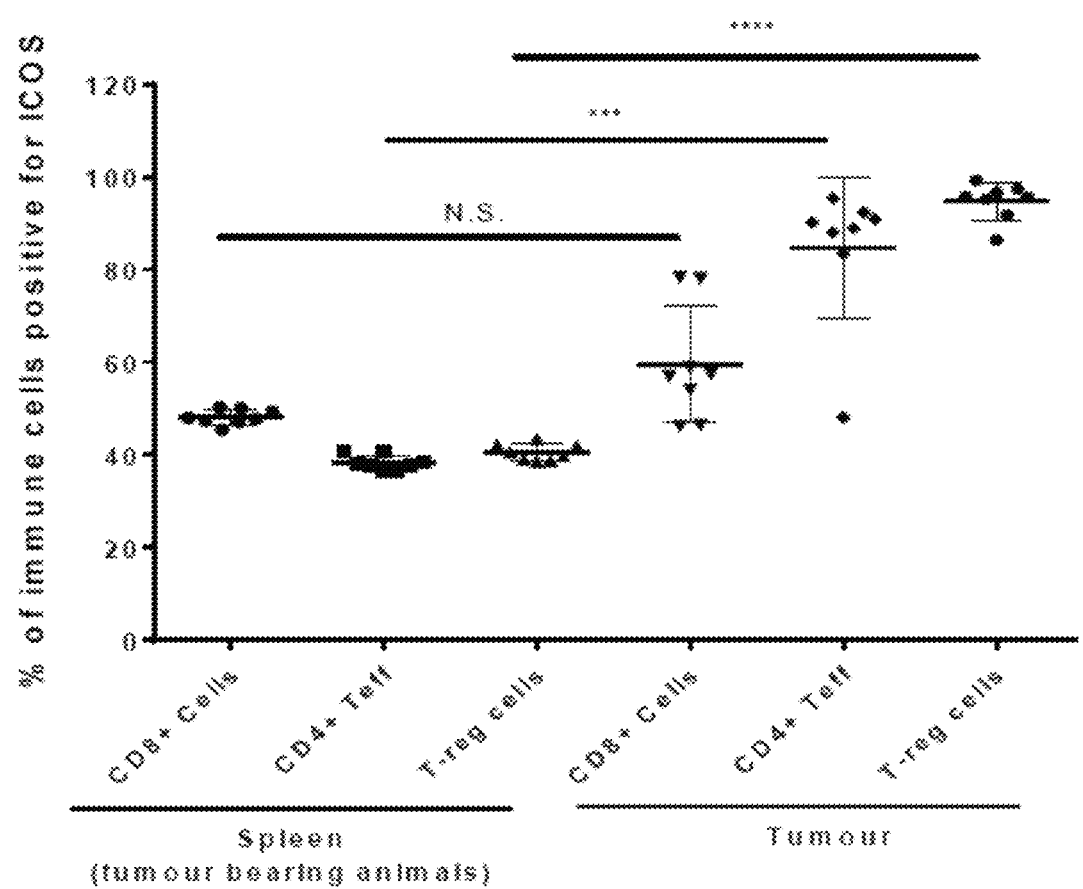
FIG. 20: Graph showing the percentage of immune cells (CD8 T-Effector, CD4 T-Effector and CD4/FoxP3 TReg cells) in the CT26 tumours and in the spleen of tumour bearing animals that are expressing ICOS on their surface. Values denote mean±SD (n=8). P values were calculated using nonparametric Dunn's multiple comparisons test. NS=not significant; *=p<0.001; **=p<0.0001.

ICOS expression was determined in the CT26 tumours and in the spleen of tumour-bearing animals. We observed an increased percentage of tumour infiltrating immune cells expressing ICOS protein (FIG. 20), indicating that immune cells in the tumours are more often positive for ICOS expression than immune cells in the periphery. TRegs in the tumour of untreated animals were nearly all (>90%) positive for ICOS expression, whereas CD8+ effector T cells in the tumour were not (approx. 60%). Comparing T cell subpopulations (again in untreated mice) in tumour with those in spleen, a significantly higher ($p<0.0001$) percentage of intra-tumoural Tregs were positive for ICOS compared with Tregs in spleen, and a significantly higher ($p<0.001$) percentage of intratumoural CD4+ Teff cells were positive for ICOS compared with CD4+ Teff cells in spleen.

Also in the mice before treatment, the level of ICOS expression was much higher on immune cells in the microenvironment of CT26 tumours, when compared with immune cells in the spleen (FIG. 21). ICOS expression was increased on the surface of all immune cell subsets analysed (CD8 T-Effector, CD4 T-Effector and CD4/FoxP3 TReg cells) in the tumour microenvironment. Note that although immune cells in the tumours and the spleen are both expressing ICOS, immune cells in the tumour are expressing significantly more ICOS (indicated by higher MFI, FIG. 21) than cells in the spleen (indicated by lower MFI, FIG. 21). Importantly, TRegs in the tumour are expressing the highest levels of ICOS, as previously reported [11].

Figure 22:
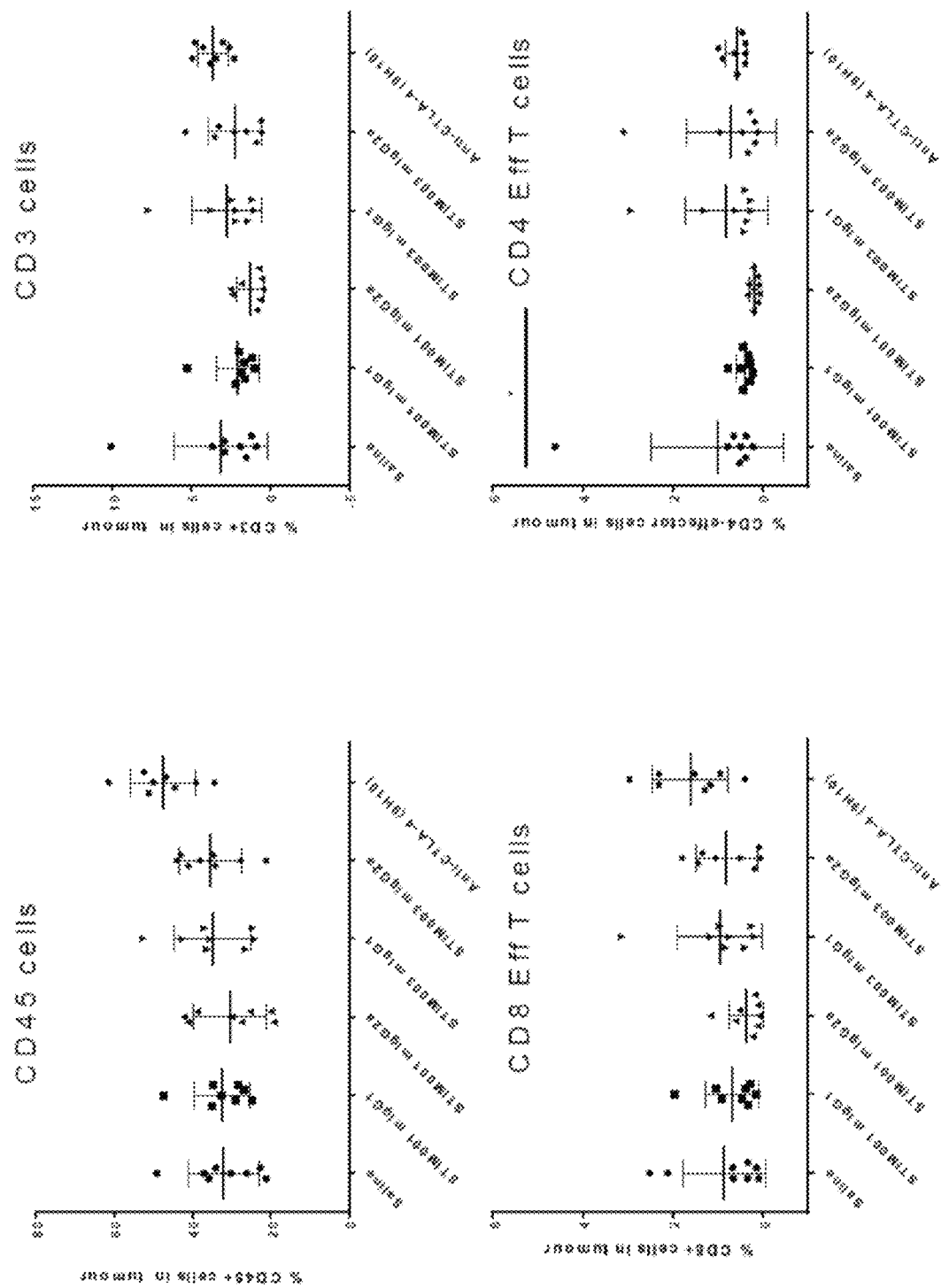
FIG. 22: Effect of STIM001 and STIM003 on the percentage of different immune cells in the microenvironment of CT26 tumours. *=p<0.05.

CT26 tumour bearing animals were treated with 2 doses of antibody STIM001 or STIM003 and with an anti-CTLA-4 antibody. The STIM antibodies did not affect the overall percentage of CD45 positive cells (a marker for immune cells) in the tumours, when used in either mIgG1 or mIgG2 format. Nor did treatment with these antibodies significantly affect the percentage of CD8 effector T cells in CT26 tumours (FIG. 22). Treatment with STIM001 in mIgG2a isotype led to a significant ($p<0.05$) depletion of CD4+ effector T cells, but none of STIM001 mIgG1, STIM003 mIgG1 and STIM003 mIgG2a affected the percentage of CD4+ effector T cells.

Anti-CTLA-4 treatment produced a notable (albeit not statistically significant) increase in CD45+ cells and CD8+ effector T cells in the TME, but did not affect CD4+ effector T cells (FIG. 22).

Figure 23:
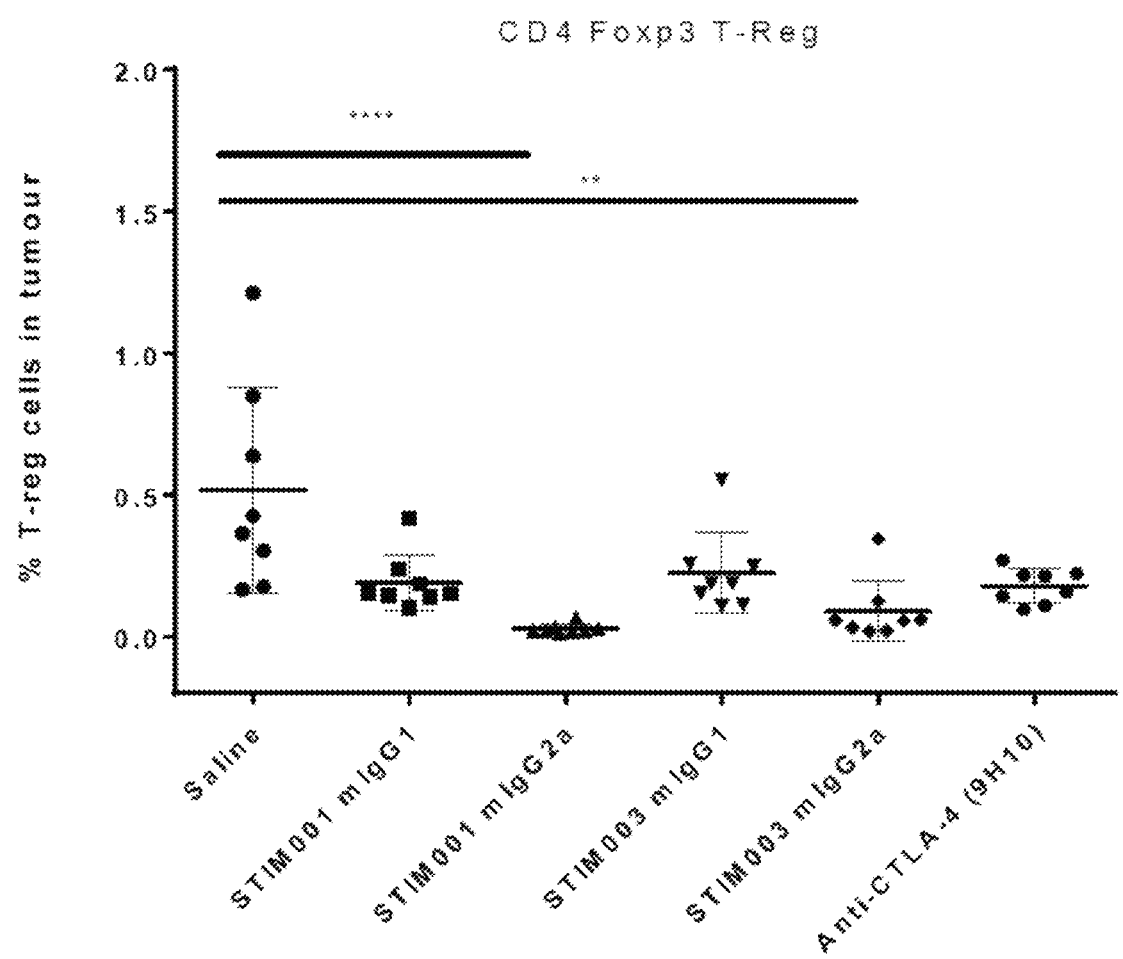
FIG. 23: Effect of antibodies STIM001 and STIM003 on the percentage of regulatory T cells (CD4+/FoxP3+ cells) in the microenvironment of CT26 tumours. =p<0.05, **=p<0.0001. Values denote mean±SD (n=8). P values were calculated using nonparametric Dunn's multiple comparisons test.

The STIM antibodies significantly affected regulatory T cells in the tumour. As shown in FIG. 23, STIM001 mIgG2a and STIM003 mIgG2a significantly and selectively depleted TRegs (which are high for ICOS expression) in the tumour microenvironment. Interestingly, the anti-CTLA4 antibody which, despite being included as a positive control for TReg depletion in this experiment, was less effective than the STIM mIgG2a antibodies at depleting TRegs.

Figure 24:
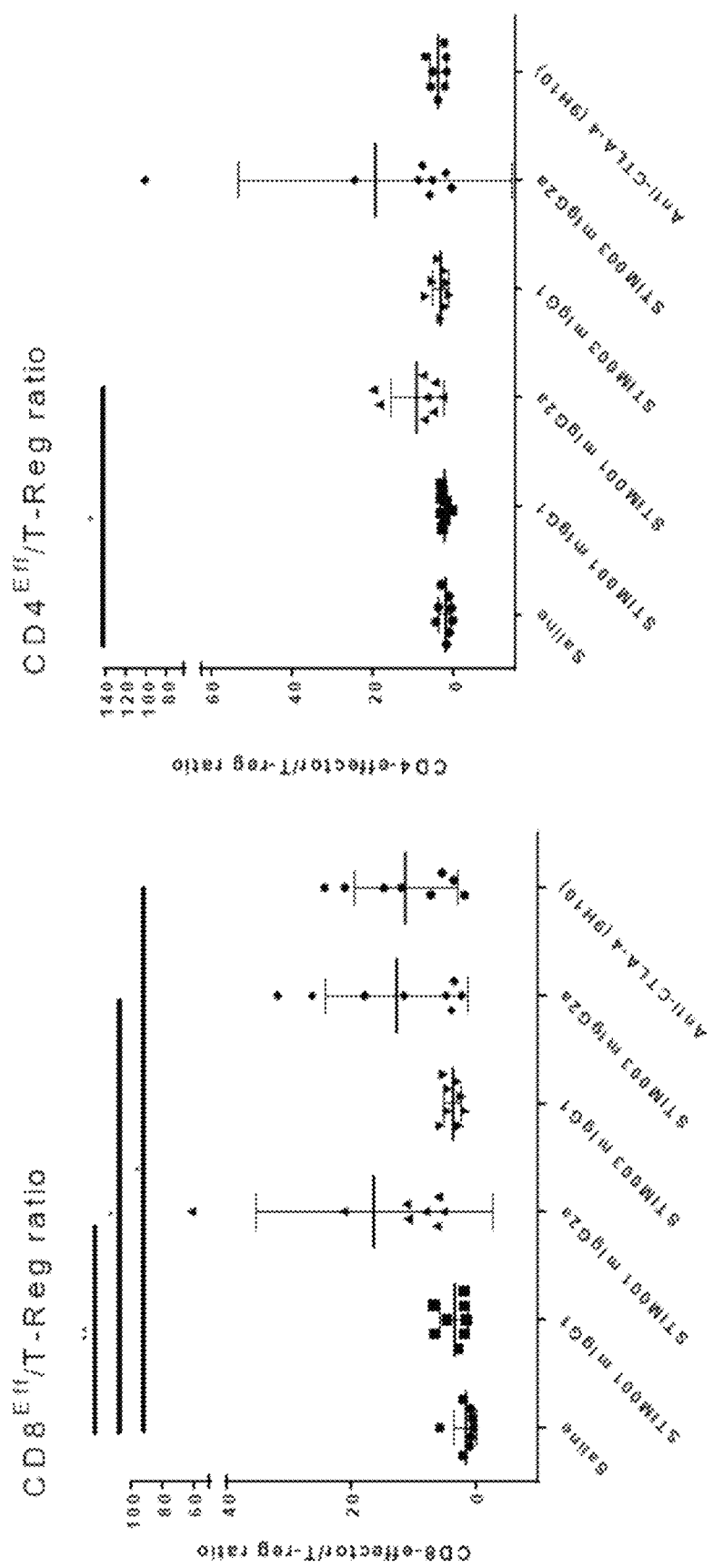
FIG. 24: STIM001 and STIM003 mIgG2 significantly increase the CD8 effector T cell to TReg ratio and the CD4 effector T cells to TReg ratio in CT26 tumours. The ratio is determined by dividing the percentage of effector cells in the tumour by the percentage of regulatory T cells in the tumour.

This selective depletion of TRegs resulted in an increase in the ratio CD8 effector T cells to TRegs in the tumour, and an increase in the ratio of CD4 effector T cells to TRegs in the tumour, both of which should favour an anti-tumour immune response. Ratio data are shown in FIG. 24.

Figure 25:
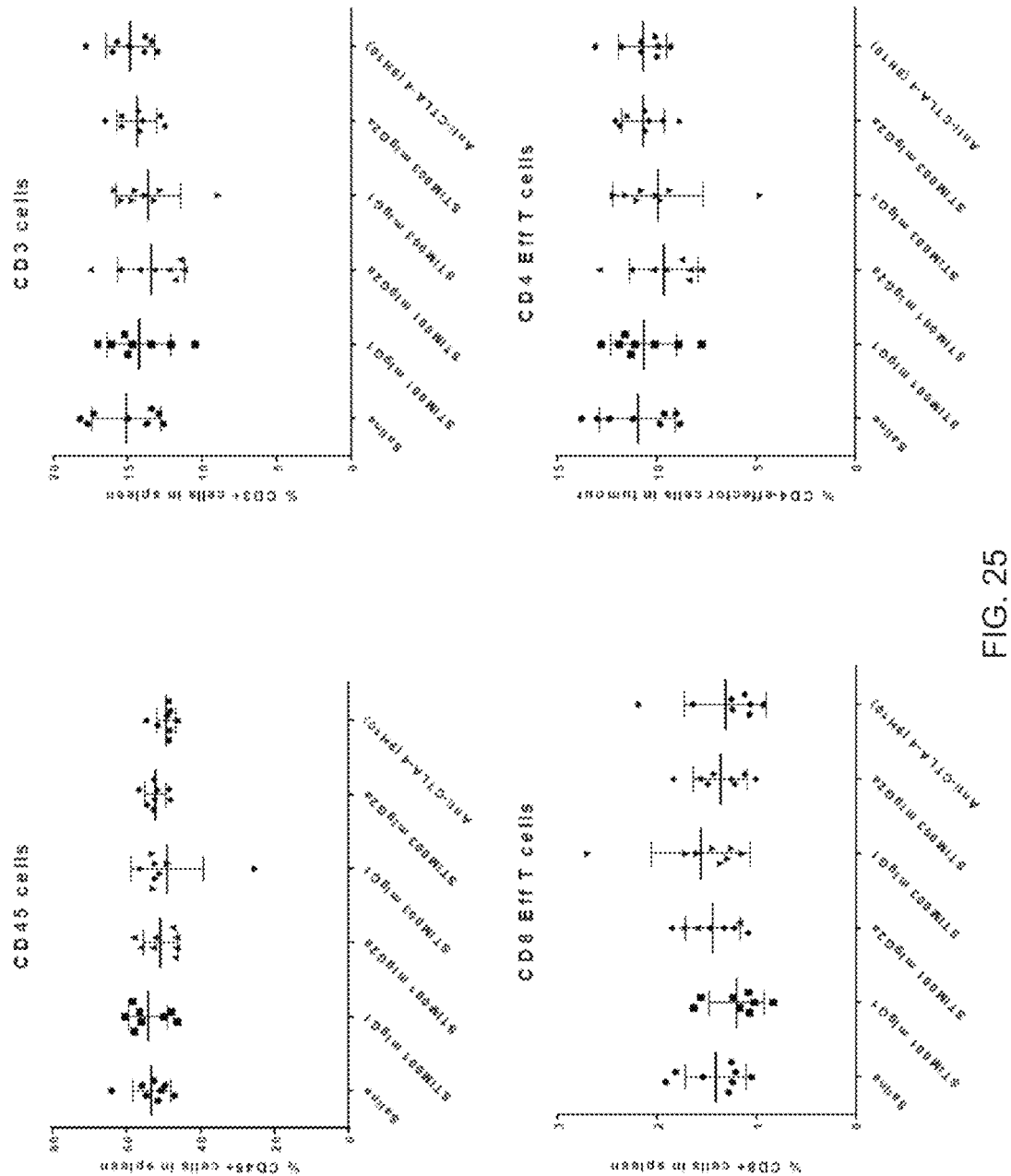
FIG. 25: Effect of antibodies on percentage of immune cells in the spleen of CT26 tumour bearing animals.
Figure 26:
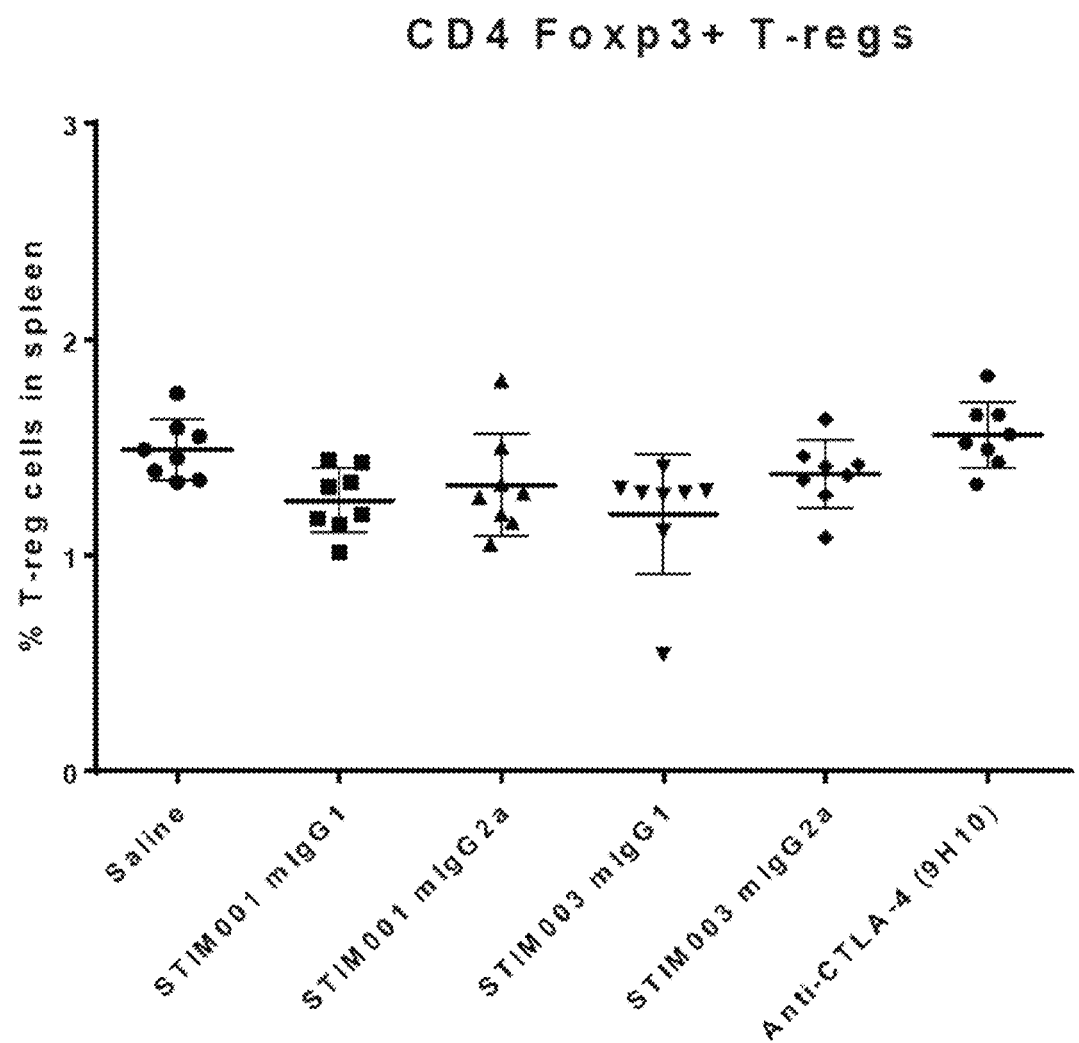
FIG. 26: Effect of antibodies on percentage of regulatory T cells (CD4+/FoxP3+ cells) in the spleen of CT26 tumour bearing animals.
Figure 27A:
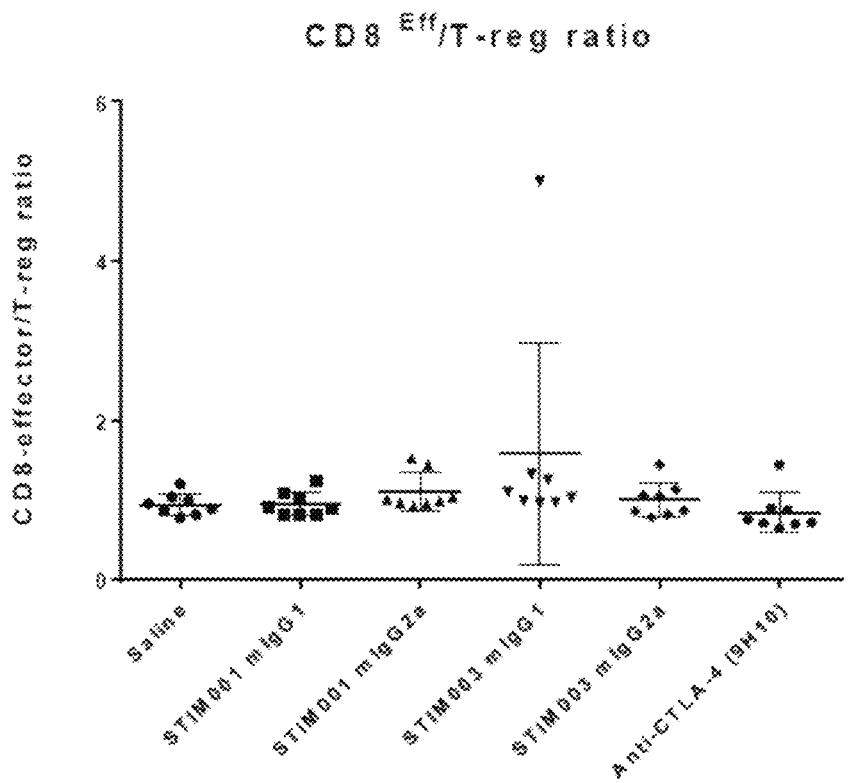
FIG. 27A CD8 effector:Treg ratio and FIG. 27B CD4:TReg ratio in spleen of CT26 tumour bearing animals.
Figure 27B:
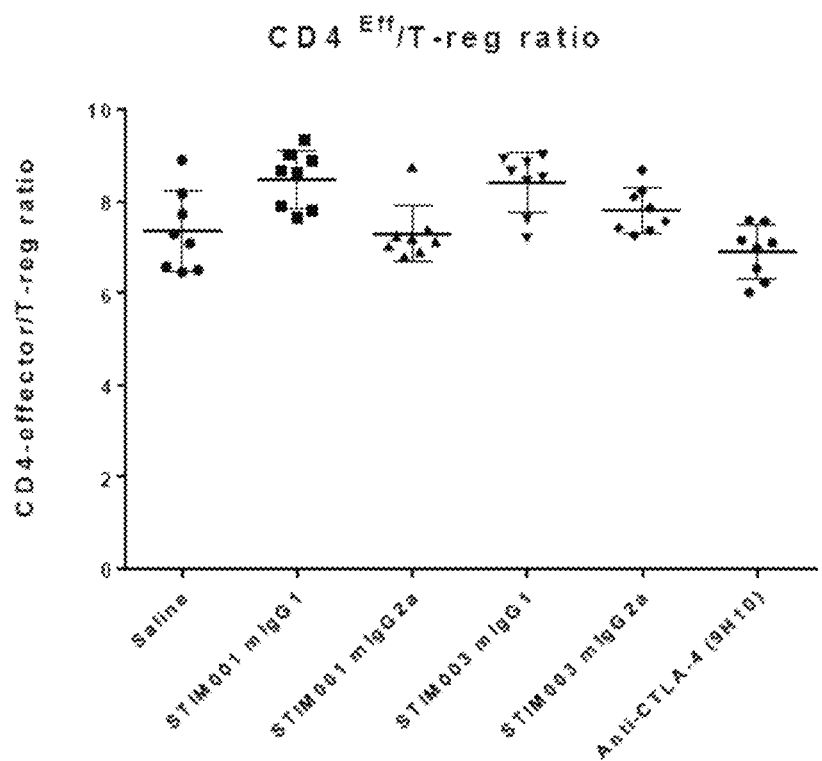

In contrast to the depletion of intratumoural Tregs by STIM001 mIgG2a and STIM003 mIgG2a, no such effect was observed on Tregs in spleen (FIG. 25, FIG. 26, FIG. 27). This indicates that the effects of the anti-ICOS antibodies on depletion of Tregs depletion was not systemic in all the tissues. Such selectivity could be advantageous for therapeutic anti-ICOS antibodies in treating tumours in patients, as preferential depletion of Tregs in the tumour microenvironment could selectively relieve suppression of anti-tumour effector T cells, while minimising side effects at other sites in the body. The anti-ICOS antibodies may thus promote an anti-tumour response in the immune system with a low risk of undesirable activation of a wider T cell response that could cause treatment-limiting autoimmune adverse events.

Example 19: Antibody Stability

STIM003 human IgG1 was tested for stability during storage, freeze/thawing and purification, and was found to maintain its stability under all tested conditions. % aggregation was determined by HPLC.

There was no significant change in the percentage of monomer (>99%) after 3 months storage at 4° C. in buffer (10 mM sodium phosphate, 40 mM sodium chloride, pH 7.0).

On thermal denaturation testing, all samples (n=15) had the same Tm (no significant difference between aliquots) and had comparable thermal denaturation curves.

There was no significant change in Tm (≈70.3° C.), the percentage of monomer or the profile on SDS-PAGE after 3 cycles of freeze and thaw.

There was no significant change in Tm (≈70.3° C.), the percentage of monomer or the profile on SDS-PAGE after 7 days' storage at room temperature.

There was 90% recovery post protein A purification.

Example 20: Monotherapeutic Efficacy of Anti-ICOS Ab Against A20 Tumour Growth in Mouse Anti-ICOS antibodies STIM001 mIgG2a and STIM003 mIgG2a each showed strong anti-tumour efficacy when used as monotherapies in vivo in a mouse A20 syngeneic model.

Materials and Methods

The efficacy study was performed in BALB/c mice using the sub-cutaneous A20 reticulum cell sarcoma model (ATCC, TIB-208). The A20 cell line is a BALB/c B cell lymphoma line derived from a spontaneous reticulum cell neoplasm found in an old BALB/cAnN mouse. This cell line has been reported to be positive for ICOSL.

BALB/c mice were supplied by Charles River UK >18 gram and housed under specific pathogen-free conditions. A total of 5×10e5 A20 cells (passage number below P20) were subcutaneously injected into the right flanks of mice. The A20 cells were passaged in vitro washed twice in PBS and re-suspended in RPMI supplemented with 10% foetal calf serum. Cell viability was confirmed to be above 85% at the time of tumour cell injection. Unless stated otherwise, antibody or isotype administration was initiated from day 8 post tumour cells injection.

STIM001 and STIM003 anti-ICOS antibodies were generated in mouse IgG2a isotype format. The mouse cross reactive anti-PD-L1 antibody (AbW) was also generated in the same isotype format (mouse IgG2a). STIM001, STIM003 and anti-PD-L1 antibodies were dosed intraperitoneally (IP) at 200 μg of each antibody twice a week starting from day 8 (dosing for 3 weeks between day 8-29) post tumour cell implantation. Animal weights and tumour volume were measured 3 times a week from the day of tumour cell injection. Tumour volume was calculated by use of the modified ellipsoid formula 1/2(Length×Width2). Mice were kept on study until their tumour reached an average diameter of 12 mm. The experiment was stopped at day 43 post tumour cell implantation. Tumour growth was monitored and compared with tumours of animals treated with isotype control (mIgG2a) antibody. Treatment groups are shown in Table E20 below.

TABLE E20

Treatment groups for A20 study.

| Group | Number of animals | Treatment regimen (twice per week for 3 weeks 7 doses) |
|---|---|---|
| 1 | 8 | mIgG2a isotype control 200 μg/mouse/each dose |
| 2 | 8 | Anti-PD-L1 mIGg2a (AbW) 200 μg/mouse/each dose |
| 3 | 8 | Anti-ICOS mIgG2a STIM001 200 μg/mouse each dose |
| 4 | 8 | Anti-ICOS mIgG2a STIM003 200 μg/mouse/each dose |

Results

Figure 30:
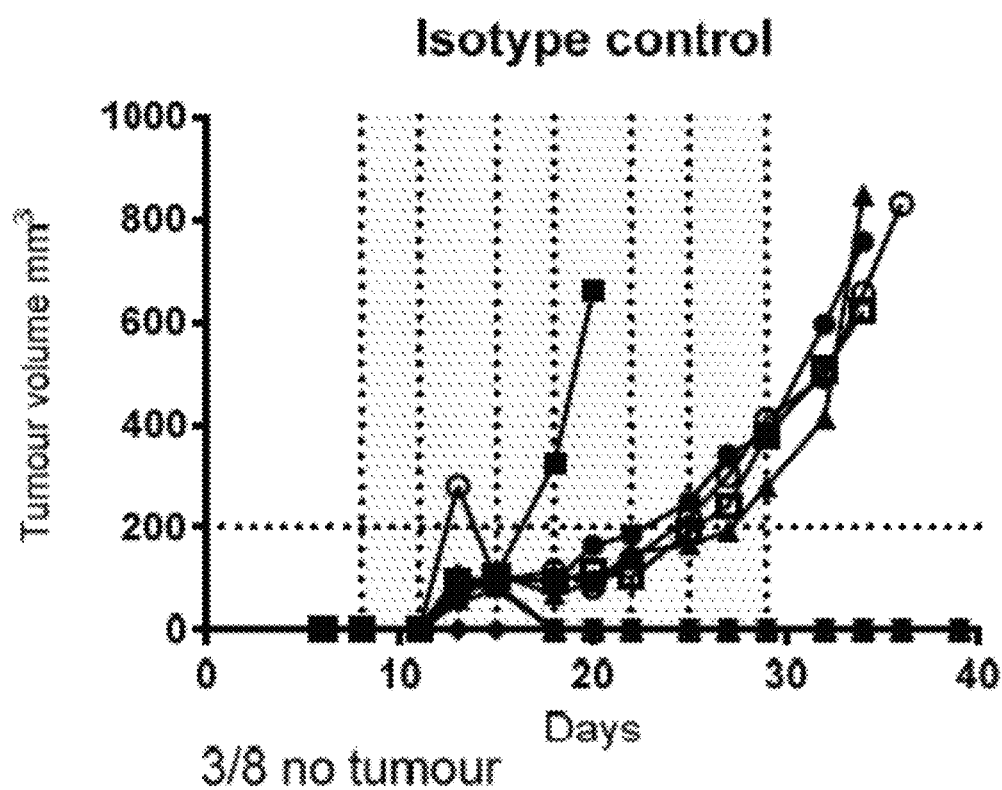
FIG. 30, FIG. 31, FIG. 32, and FIG. 33: Graphs showing volumes of A20 tumours over time in mice for the study described in Example 20. Each treatment group is represented by a spider plot showing tumour size in individual animals, n=8 per group. For each group, the number of animals with no sign of tumour (indicating cured of disease) is indicated on the bottom left of the graph. Dosing was performed on days 8, 11, 15, 18, 22, 25 and 29 post tumour cell implantation and the dosing time is indicated by the grey shaded area. Compared with the control group (FIG. 30) and the anti-PD-L1 treatment group (FIG. 31), the STIM001 mIgG2a (FIG. 32) and STIM003 mIgG2a (FIG. 33) treatment groups showed significant inhibition of A20 tumour growth.
Figure 31:
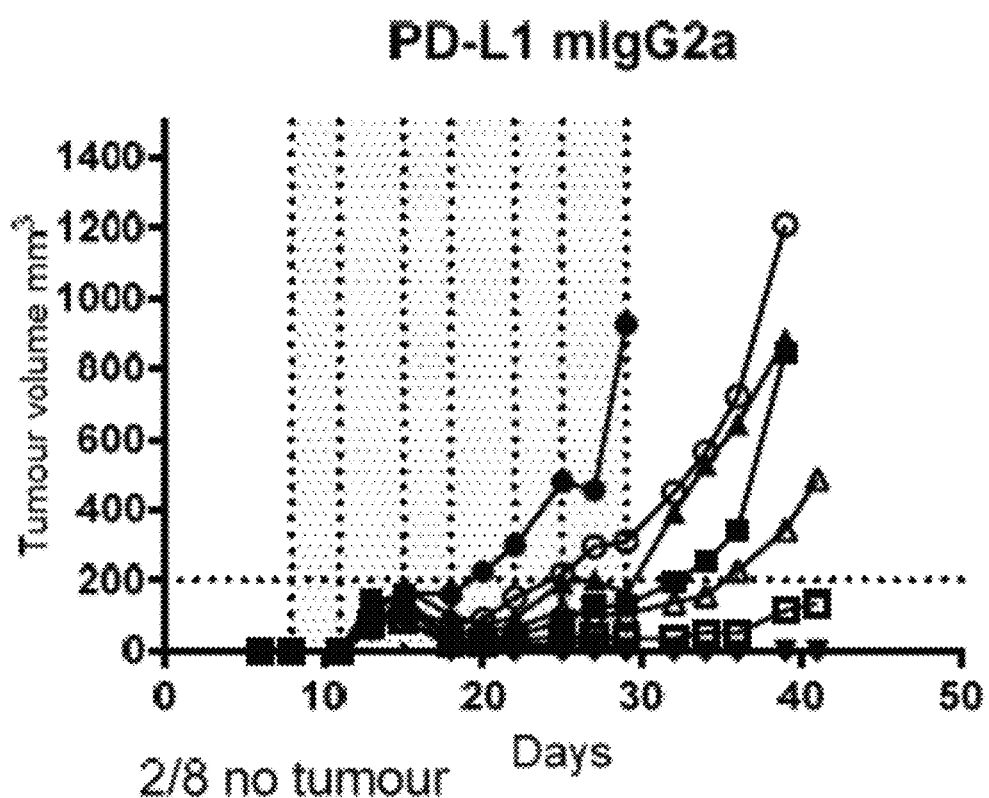
Figure 32:
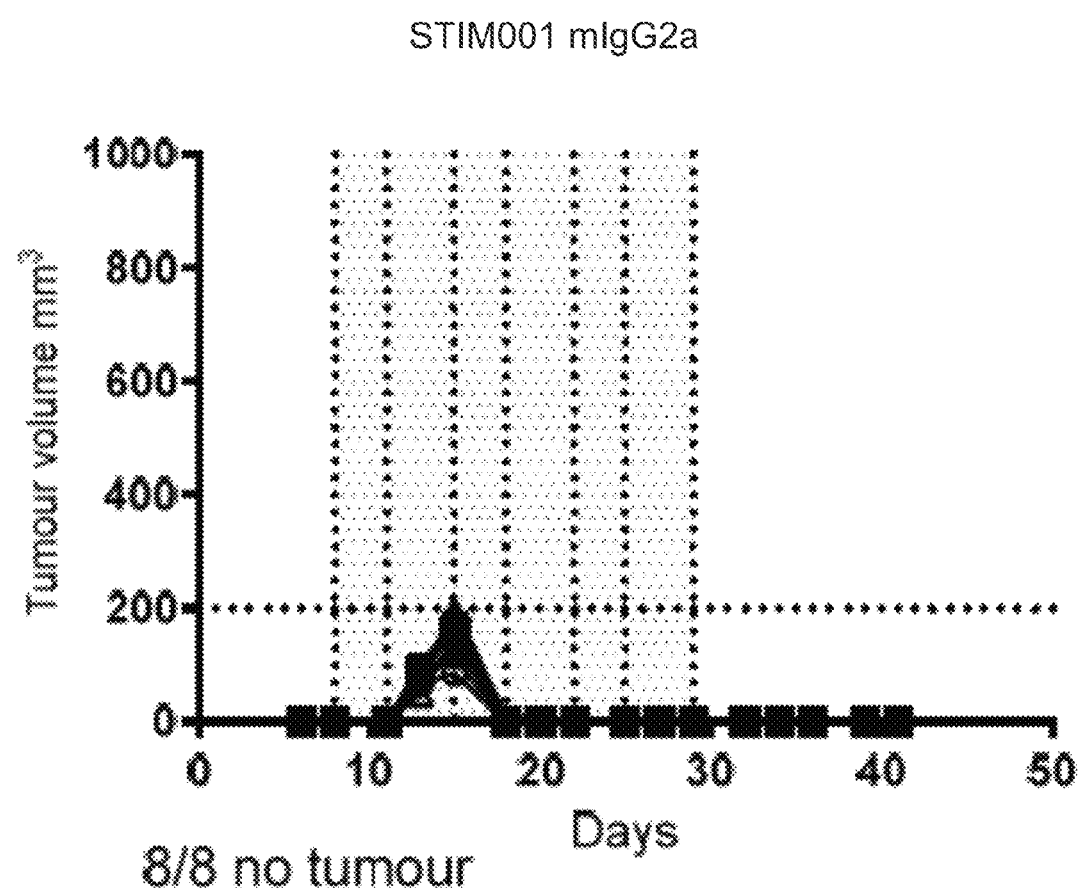
Figure 33:
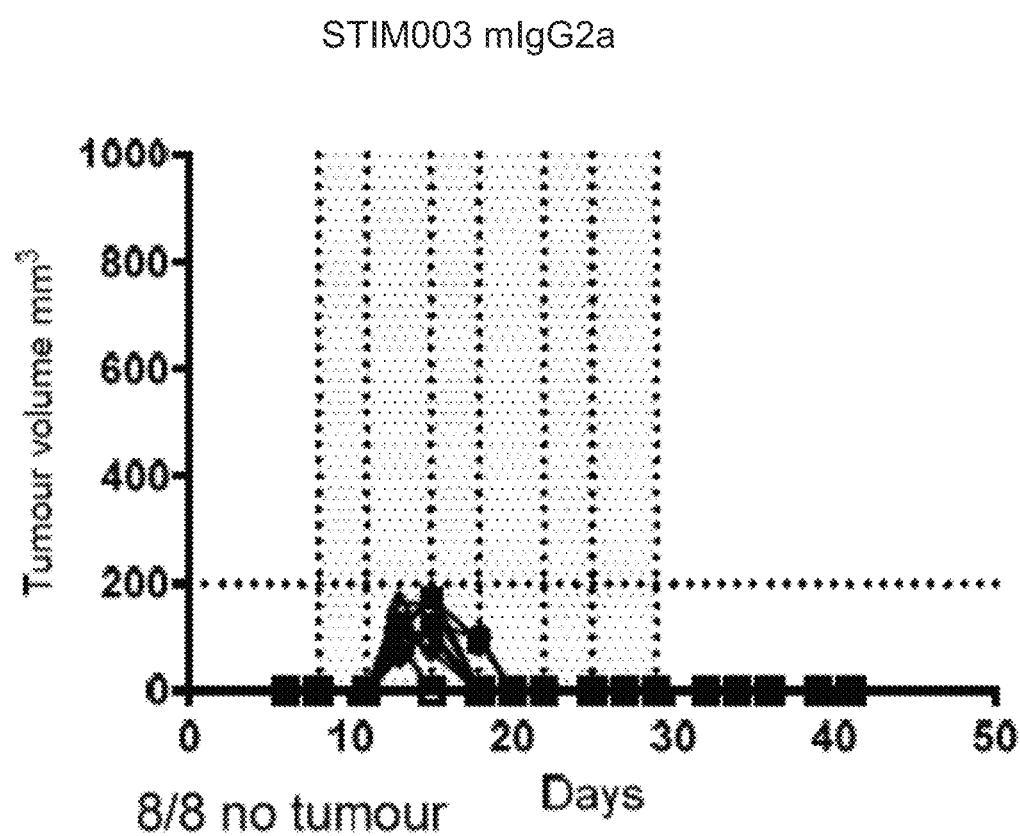

Monotherapy administration of either STIM001 or STIM003 (mIgG2a) in the A20 tumour model produced a complete anti-tumour response (FIG. 32, FIG. 33). All the animals administered with either STIM001 or STIM003 were cured of the disease. This contrasts with the results in the isotype control and PD-L1 mIgG2a groups (FIG. 30, FIG. 31). In rare cases, regression of tumours was observed for some animals in the isotype control (spontaneous regression) and anti-PDL-1 groups, but treatment with anti-ICOS antibody produced significantly greater efficacy. At the end of the study, 3 of 8 control animals and 2 of 8 anti-PDL-1 treated animals had no tumour. However, all animals treated with either STIM001 or STIM003 were tumour free at the end of the study (8 of 8 mice in both groups), representing 100% cure using the anti-ICOS antibodies.

Example 21: Strong Anti-Tumour Efficacy In Vivo in the J558 Myeloma Syngeneic Model for Combination of Anti-ICOS Antibody and Anti-PD-L1 Antibody Anti-ICOS antibody STIM003 mIgG2a and anti-PD-L1 antibody AbW mIgG2a were administered individually and in combination in the J558 tumour model. This is a syngeneic mouse model of myeloma. The anti-ICOS antibody was found to inhibit tumour growth when dosed as monotherapy or in combination with anti-PD-L1.

Materials & Methods

Anti-tumour efficacy studies were performed in Balb/c mice using the sub-cutaneous J558 plasmacytoma:myeloma cell line (ATCC, TIB-6). Balb/c mice were supplied by Charles River UK at 6-8 weeks of age and >18 g and housed under specific pathogen-free conditions. A total of 5×10$^6$ cells (passage number below P15) were subcutaneously injected (in 100 μl) into the right flanks of mice. Unless stated otherwise, on day 11 post tumour cells injection, the animals were randomised based on tumour size and treatments were initiated. The J558 cells were passaged in vitro by using TrypLE™ Express Enzyme (Thermofisher), washed twice in PBS and resuspended in DMEM supplemented with 10% foetal calf serum. Cell viability was confirmed to be above 90% at the time of tumour cell injection.

Treatment was initiated when the tumours reached an average volume of ~140 mm^3. Animals were then allocated to 4 groups with similar average tumour size (see Table E-21 for the dosing groups). Both antibodies, which are mouse cross-reactive, were dosed IP from day 11 (post tumour cell implantation) twice a week for 3 weeks (FIG. 38) unless the animals had to be removed from study due to welfare (rare) or tumour size. As a control, a group of animals (n=10) was dosed at the same time using a saline solution. For the combination group, both STIM003 and anti-PDL1 antibodies were dosed concurrently IP at 60 µg and 200 µg respectively (in 0.9% saline). Tumour growth was monitored over 37 days and compared to tumours of animals treated with saline. Animal weight and tumour volume were measured 3 time a week from the day of tumour cell injection. Tumour volume was calculated by use of the modified ellipsoid formula $1/2(\text{Length} \times \text{Width}^2)$. Mice were kept on studies until their tumour reached an average diameter of 12 $mm^3$ or, in rare cases, when incidence of tumour ulceration was observed (welfare).

TABLE E21

Treatment groups for J558 efficacy study.

| Groups | Number of animals | Treatment regimen twice per week from day 11 |
|---|---|---|
| 1 | 10 | Saline |
| 2 | 8 | Anti-PD-L1 mIgG2a 200 µg (AbW) |
| 3 | 8 | Anti-ICOS STIM003 mIgG2a/anti-PD-L1 mIgG2a (AbW) combination 60 µg/200 µg (respectively) |
| 4 | 8 | Anti-ICOS STIM003 mIgG2a 60 µg |

Results

Figure 38:
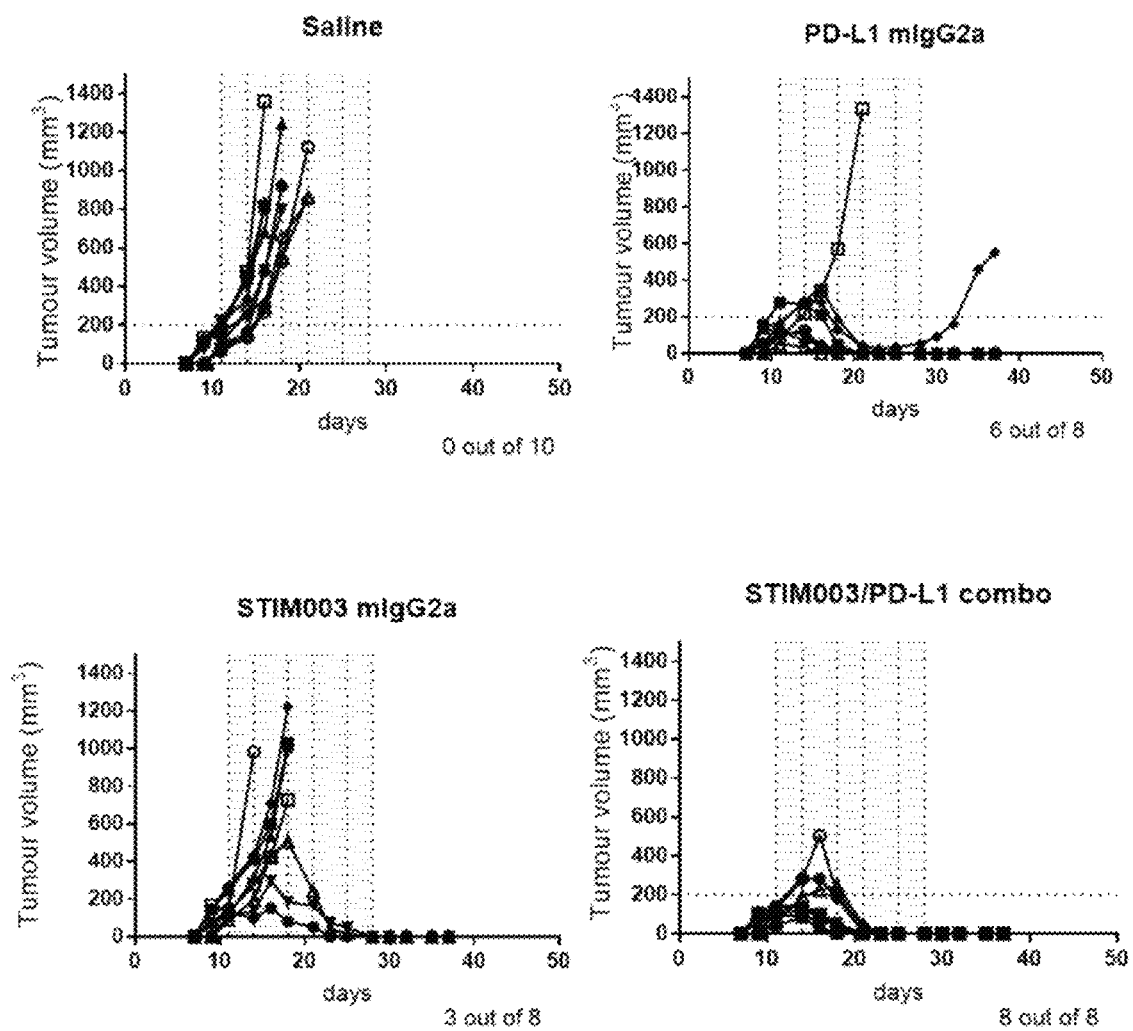
FIG. 38: Effect of STIM003 (anti-ICOS) and AbW (anti-PD-L1) mIgG2a antibodies in the J558 syngeneic model. Each treatment group is represented by a "spider plot" showing the tumour size of individual animals (n=10 or n=8 per group). STIM003 monotherapy demonstrated some efficacy with 3 of 8 animals cured from their disease. Similarly anti-PDL1 was effective in this model with 6 out of 8 animals cured from their disease by day 37. When combined with anti-PDL1 antibodies, STIM003 mIgG2 fully inhibited tumour growth and improved the survival of treated animals. For each group, the number of animals cured of their disease is indicated on the bottom right of the respective graph. Dosing days are indicated by dotted lines (day 11, 15, 18, 22, 25 and 29).

J558 syngeneic tumours were highly aggressive and all the animals in the saline control group (n=10) had to be removed from studies by day 21 due to tumour size. The anti-STIM003 mIgG2a and the anti-PDL1 mIgG2a both demonstrated good efficacy as monotherapies in this model with 37.5% and 75% of the animals cured of disease, respectively. Importantly, combination of the two antibodies resulted in 100% of the animals having rejected the plasmacytoma tumours by day 37. Data are shown in FIG. 38.

Example 22: Administration of Anti-PD1 Increases ICOS Expression on TILs Significantly More than Anti-PD-L1 Antibody A pharmacodynamic study was performed in animals harbouring established CT26 tumours to evaluate the effect of treatment with anti-PD-L1 or anti-PD-1 antibodies on ICOS expression on subsets of tumour infiltrating lymphocytes (TILs). The following antibodies were compared:
  anti-PD-L1 AbW mIgG1 [limited effector function]
  anti-PD-L1 AbW mIgG2a [with effector function]
  anti-PD-L1 10F9.G2 rat IgG2b [with effector function]
  anti-PD1 antibody RMT1-14 rat IgG2a [effector null].
Tumours of treated mice were isolated, dissociated to single cells and stained for CD45, CD3, CD4, CD8, FOXP3 and ICOS.

Materials & Methods

Rat anti-PD-1 RMP1-14 IgG2a (BioXCell; Catalog number: BE0146), rat anti-PD-L1 10F9.G2 IgG2b (Bio-Legend; Catalog number: 124325) and anti-PD-L1 AbW mIgG1 and mIgG2a were tested in the CT26 tumour model by dosing i.p. with 130 µg on days 13 and 15 post tumour cell implantation. On day 16, animals were culled and the mouse tumours were harvested for FACS analysis. Tumours were dissociated using a mouse tumour dissociation kit (Miltenyi Biotec) and homogenised. The resulting cell suspensions were clarified through 70 µM filters, pelleted and resuspended in FACS buffer at 2 million cells/well in a 96 well plate. The cell suspensions were incubated with anti-16/32 mAb (eBioscience) and stained with FACS antibodies specific for CD3 (17A2), CD45 (30-F11), CD4 (RM4-5), CD8 (53-6.7) and ICOS (7E.17G9) all obtained from eBioscience Ltd. Cells were also stained with LiveDead Yellow fixable viability dye (Life technologies). For the Foxp3 intracellular staining, samples were fixed, permeabilised, and stained with antibody specific for Foxp3 (eBioscience, FJK-16s). The samples were resuspended in PBS and data aquired on the Attune flow cytometer (Invitrogen) and analysed using FlowJo V10 software (Treestar).

Results

Figure 39A:
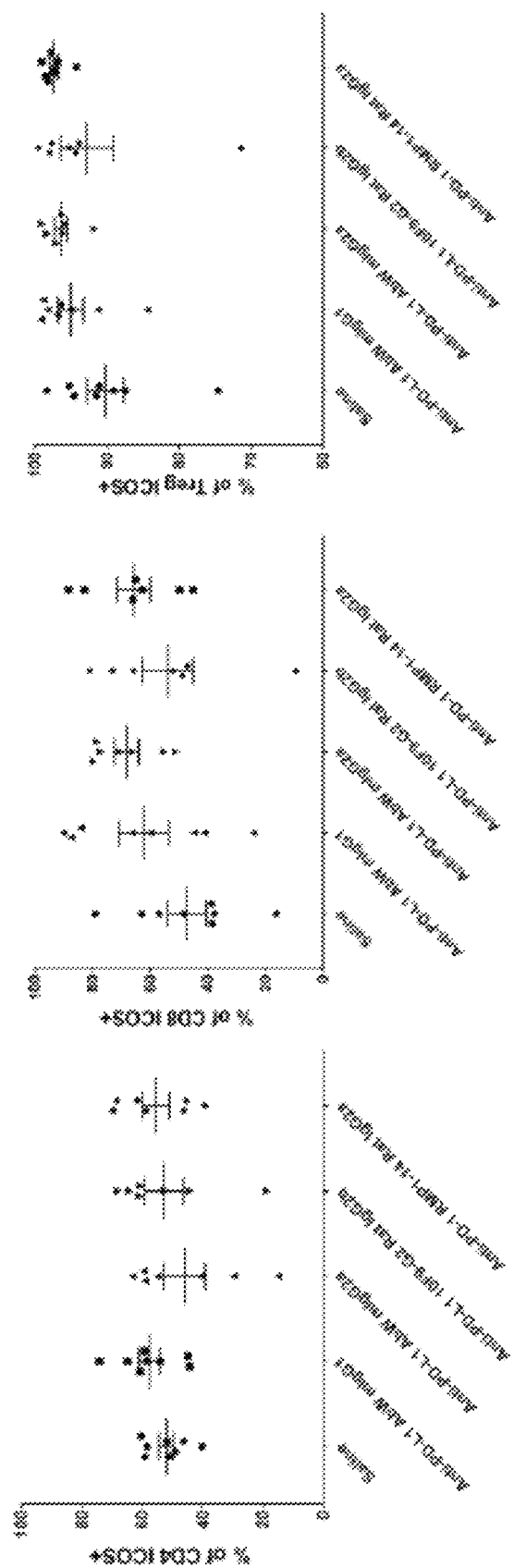
FIG. 39A and FIG. 39B: Quantification of ICOS expression (percentage of positive cells and relative expression/dMFI) on the different TILS cell subtypes in the tumour tissue.
Figure 39B:
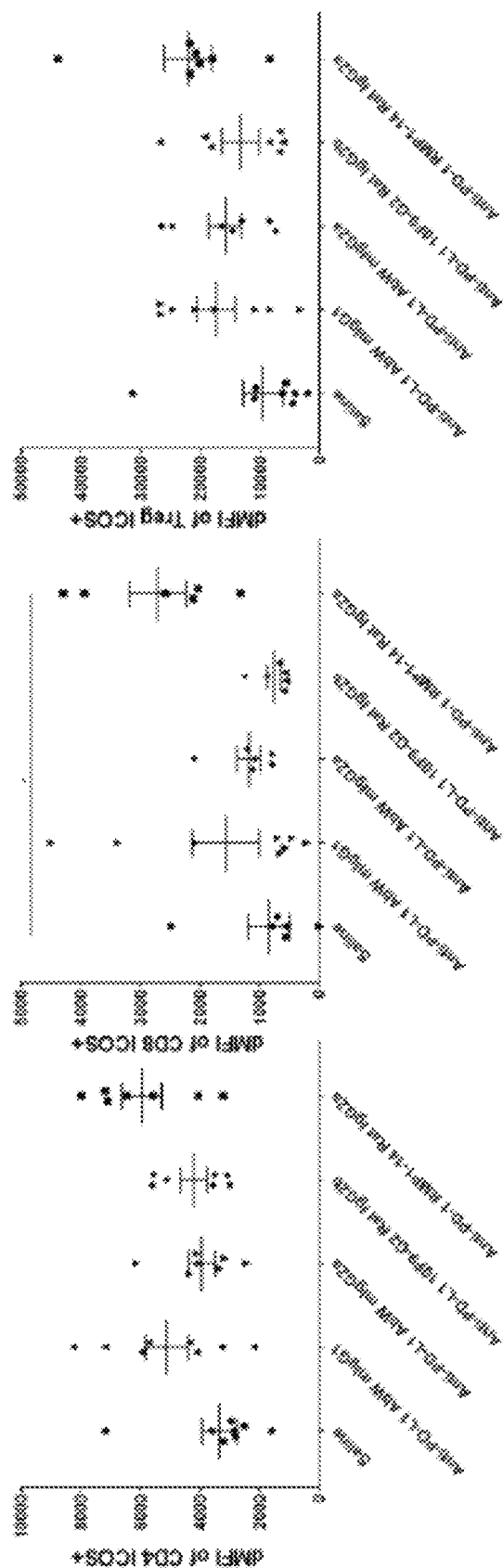

Treatment with anti-PD1 and anti-PD-L1 antibodies only resulted in a marginal increase in the percentage on CD8 cells and T Regs expressing ICOS at the measured timepoint. However, in response to anti-PD1 rat IgG2a, a clear and significant (over the saline treated group) increase in ICOS expression (increased dMFI) was observed on the surface of ICOS+ve CD8 cells. ICOS expression was also noted to be upregulated on CD4 effector and CD4 T Reg cells although this did not reach statistical significance. This anti-PD1 antibody induced a marked increase in ICOS expression on CD8 effector cells that was barely seen with the anti-PD-L1 mIgG2a. Similarly, when comparing the different formats of anti-PD-L1 antibodies, in some of the animals treated it was observed that the antibody having the lowest effector function (mIgG1) was associated with higher ICOS expression on effector CD8 and CD4 cells when compared with antibody having effector function (mIgG2a and ratIgG2b), which rarely showed this. See FIG. 39.

An increase in ICOS expression on effector CD8/CD4 T cells may have the effect of rendering these cells more sensitive to depletion by anti-ICOS antibody (e.g., on treatment of mice with STIM003 mIgG2a). An antibody that exhibits lower ICOS induction in effector CD8 and CD4 T cells may be preferable for use in combination with anti-ICOS antibody. The data from this study indicate that anti-PD-L1 effector positive antibody may be especially suitable for combination with anti-ICOS effector positive antibody, reflecting the anti-tumour efficacy observed when combining anti-PDL1 mIgG2a with STIM003 mIgG2a reported in other Examples herein.

Example 23: Strong Anti-Tumour Efficacy of Single Dose Anti-ICOS Antibody Monotherapy In Vivo in a B Cell Lymphoma Syngeneic Model This experiment confirms the anti-tumour efficacy of STIM003 mIgG2a as monotherapy. Strong anti-tumour efficacy was demonstrated after short exposure of STIM003 mIgG2a.

Materials & Methods

Efficacy studies were performed in BALB/c mice using the sub-cutaneous A20 Reticulum Cell Sarcoma model (ATCC number CRL-TIB-208). BALB/c mice were supplied by Charles River UK at 6-8 weeks of age and >18 g and housed under specific pathogen-free conditions. A total of 5×10E5 A20 cells (passage number below P20) were subcutaneously injected into the right flanks of mice. Treatments were initiated at day 8 post tumour cells injection as shown in the table below. The A20 cells were passaged in vitro by using TrypLE™ Express Enzyme (Thermofisher), washed twice in PBS and resuspended in RPMI supplemented with 10% foetal calf serum. Cell viability was confirmed to be above 85% at the time of tumour cell injection. STIM003 mIgG2a was used either as a single dose (SD) of 60 μg (equivalent to 3 mg/kg for a 20 g animal) or as multiple doses (MD, twice a week for 3 weeks) of 60 μg. Anti-tumour efficacy observed in response to the two schedules was compared to that of animals "treated" with saline (MD, twice a week for 3 weeks). The antibodies were dosed intraperitoneal (IP) as 1 mg/ml in 0.9% saline. Animal weight and tumour volume were measured 3 times a week from the day of tumour cell injection. Tumour volume was calculated by use of the modified ellipsoid formula 1/2 (Length×Width$^2$). Mice were kept on study until their tumour reached an average diameter of 12 mm or, rarely, when incidence of tumour ulceration was observed (welfare).

TABLE E23-1

Treatment groups.

| Group | Number of animals | Treatment regimen (IP injection) |
|---|---|---|
| 1 | 10 | Saline (multiple dose from day 8, twice a week for 3 weeks) |
| 2 | 10 | STIM003 mIgG2 A (multiple dose from day 8, twice a week for 3 weeks) |
| 3 | 10 | STIM003 mIgG2 A (Single dose on day 8) |

Results

Figure 40A:
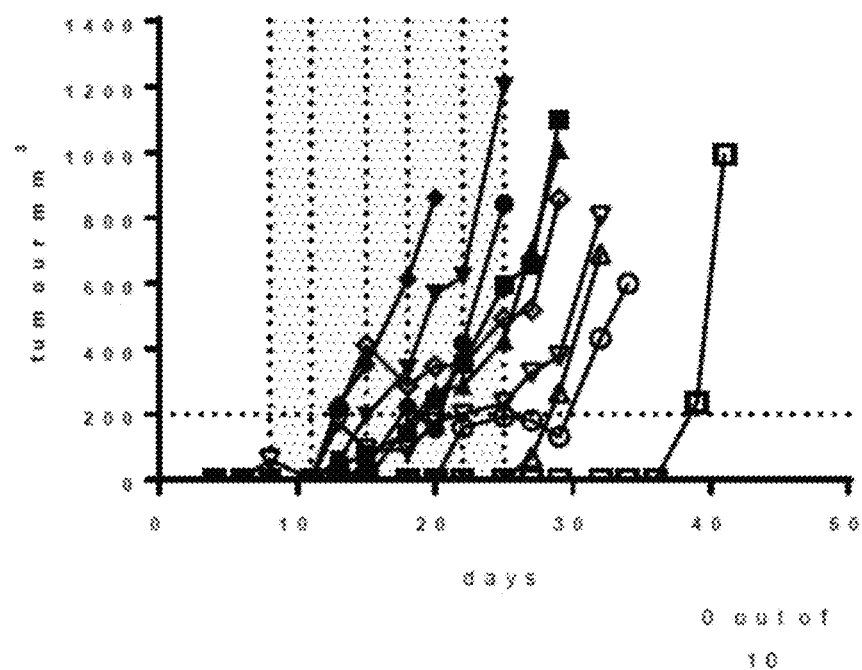
FIG. 40A, FIG. 40B, and FIG. 40C: Data from A20 in vivo efficacy study. Each treatment group is represented by a "spider plot" showing the tumour size of individual animals (n=10 per group). For each group, the number of animals cured of their disease is indicated on the respective graph. For the multiple dose, dosing was on days 8, 11, 15, 18, 22 and 25, indicated by dotted lines. For the single dose, animals received injection IP only on day 8.
Figure 40B:
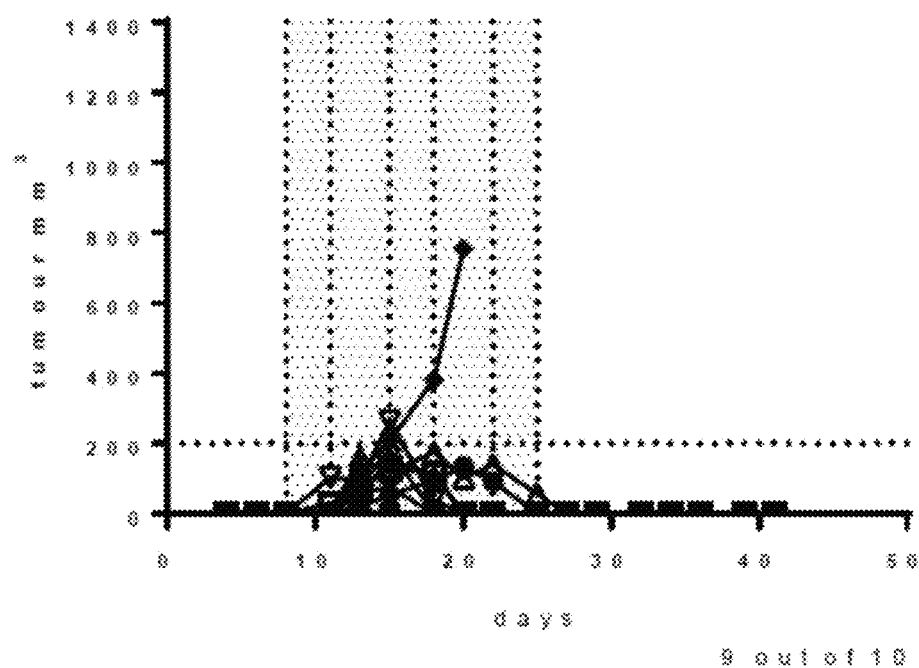
Figure 40C:
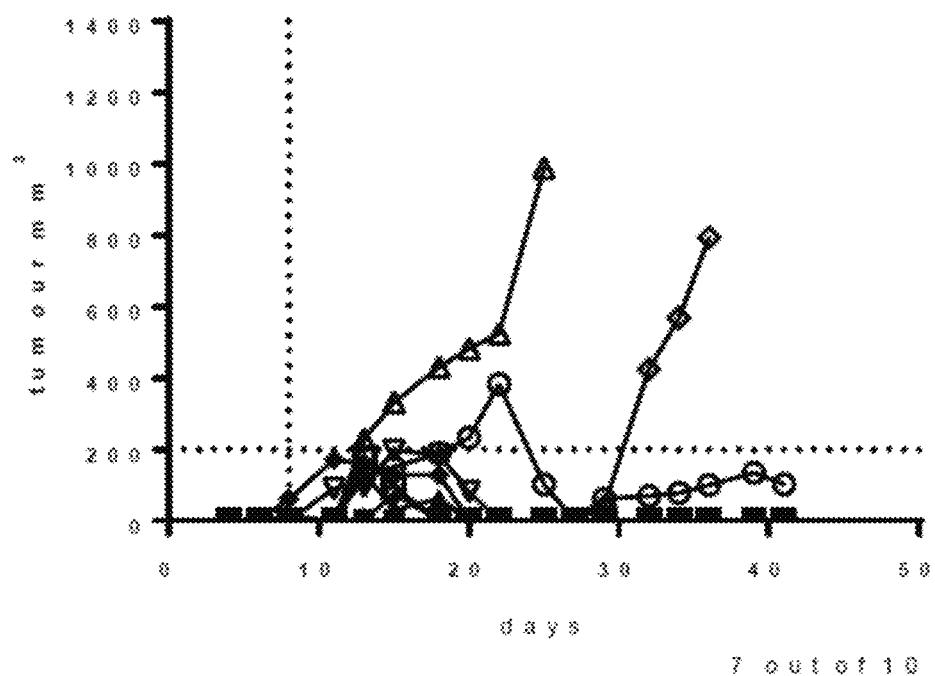

Both multiple and single dose of STIM003 mIgG2a resulted in strong and significant monotherapy anti-tumour efficacy as shown by the number of animals with no signs of tumour growth at endpoint (Day 41). SD resulted in 7 our 10 animals cured from the disease whereas the multiple dose cured 9 out of 10 animals injected with A20 B cell lymphoblast. All animals in the saline treated group had to be removed from the study by day 40 due to tumour size. See FIG. 40.

Humane endpoint survival statistics were calculated from the Kaplan-Meier curves (FIG. 41) using GraphPad Prism V7.0. This approach was used to determine if the treatments were associated with improved survival. The Hazard Ratio (Mantel-Haenszel) values and their associated P values (Log-Rank Mantel-Cox) are shown in the table below.

TABLE E23-1

Figure 41:
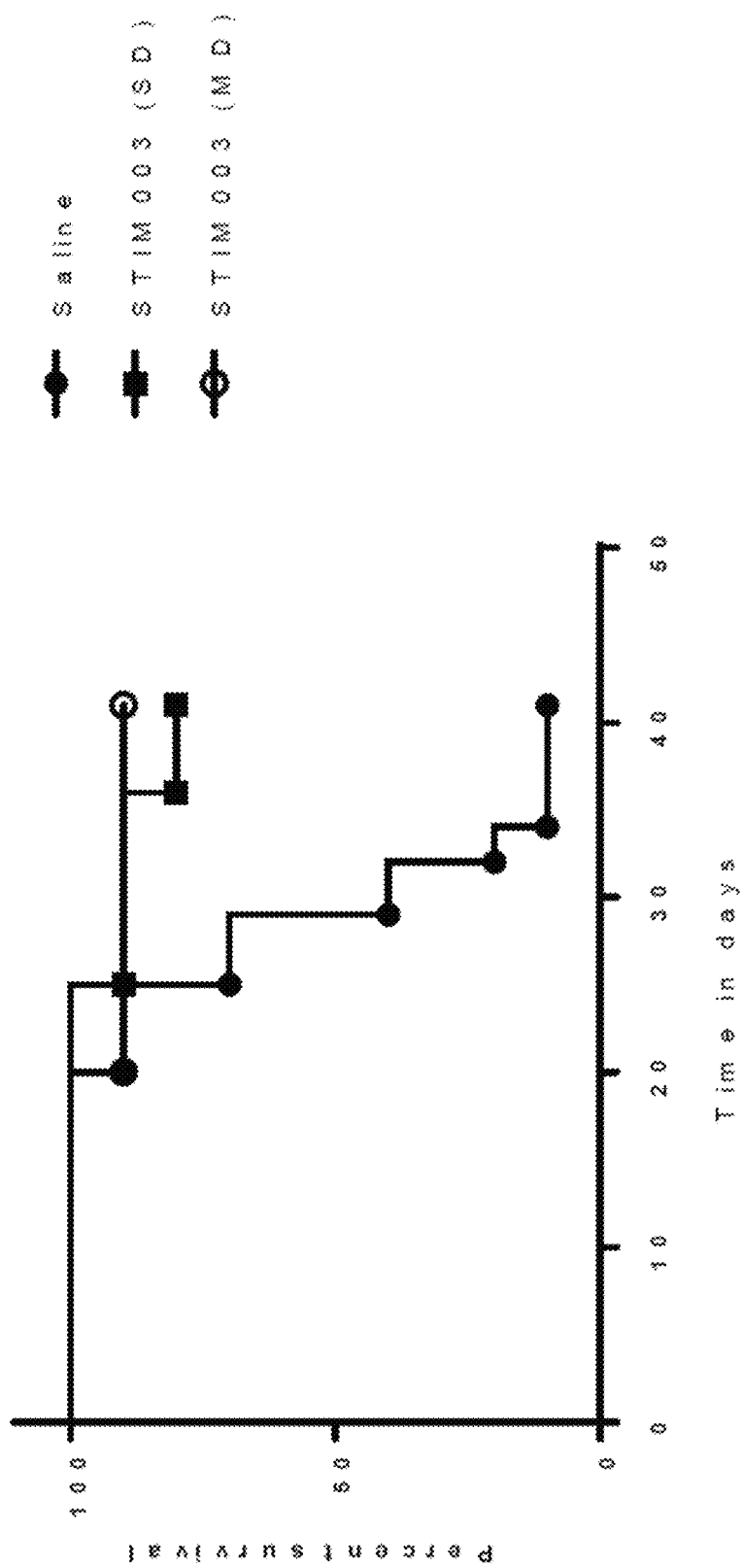
FIG. 41: Kaplan-Meier curves for study reported in Example 23 with STIM003 mIgG2a 60 μg fixed dose. SD=single dose, day 8. MD=multiple doses BIW from day 8.
Figure 42A:
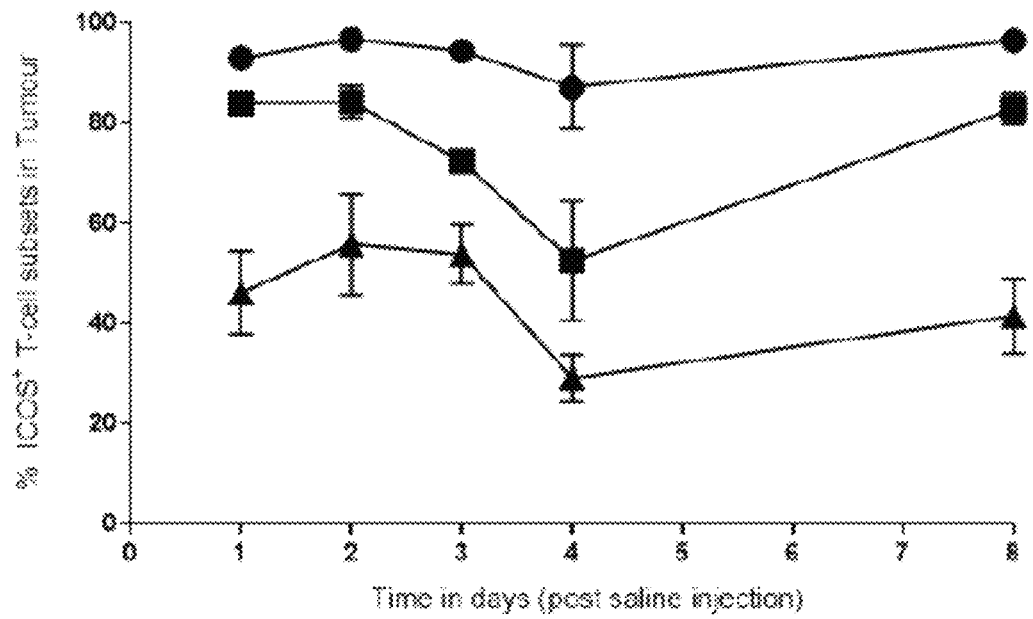
FIG. 42A, FIG. 42B, FIG. 42C, FIG. 42D, FIG. 42E, FIG. 42F, FIG. 42G, and FIG. 42H: ICOS expression on major T cells subsets (T-reg [CD4+/FoxP3+], CD4 Eff [CD4+/FoxP3-]cells and CD8+) from CT26 tumour bearing animals (n=4 per time point) dosed with saline. Immune cells phenotyping were conducted on day 1, 2, 3, 4 and 8 post treatment and stained for ICOS expression in all the tissues at all time points.
Figure 42B:
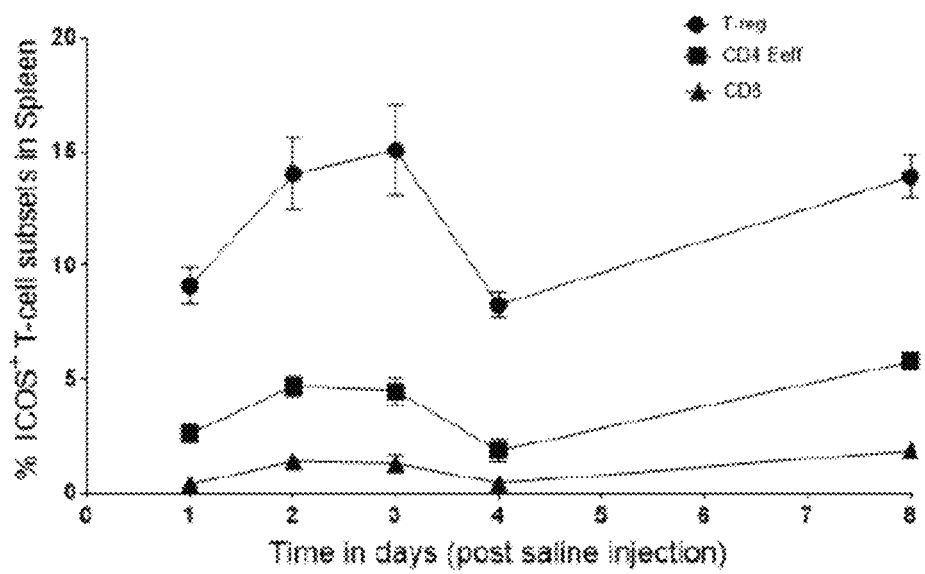
Figure 42C:
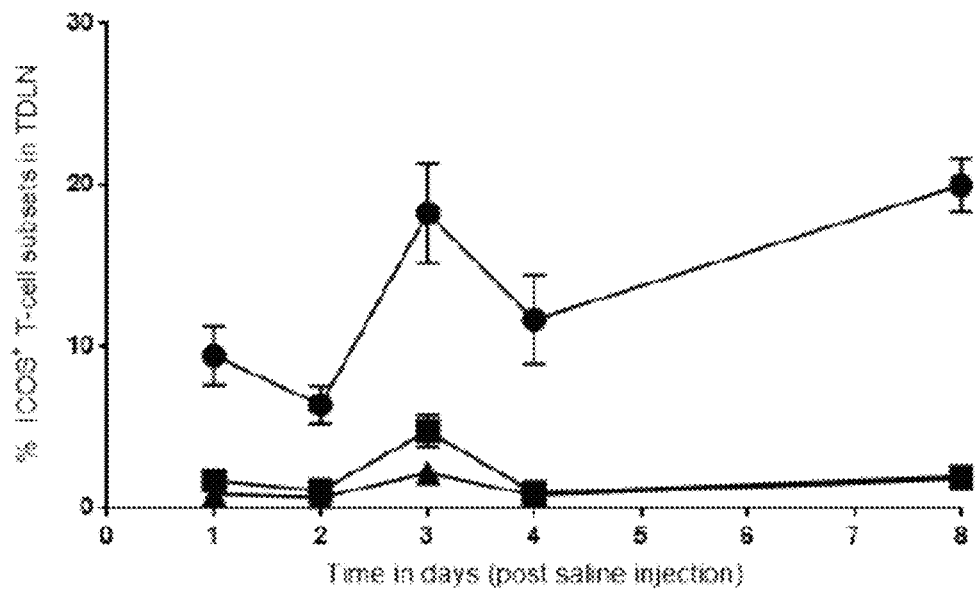
Figure 42D:
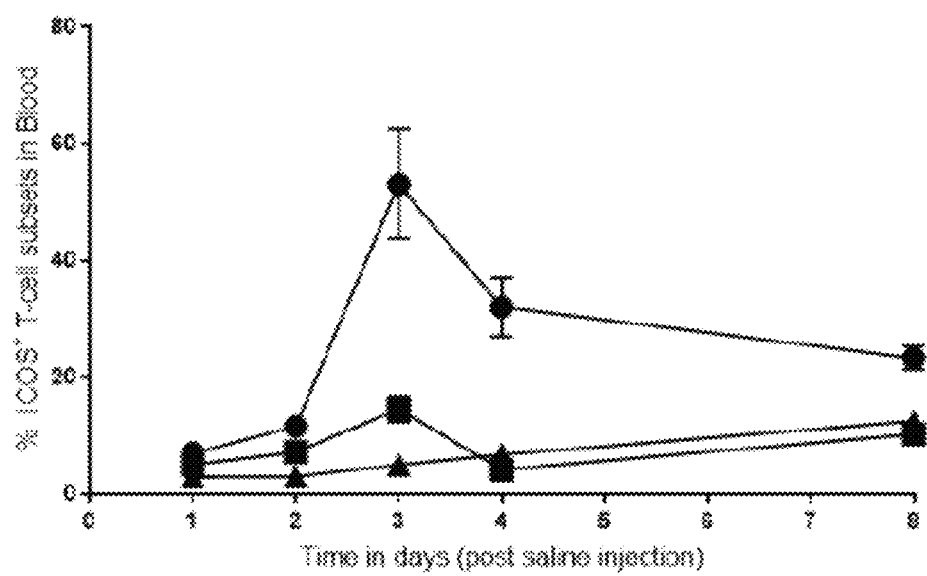
Figure 42E:
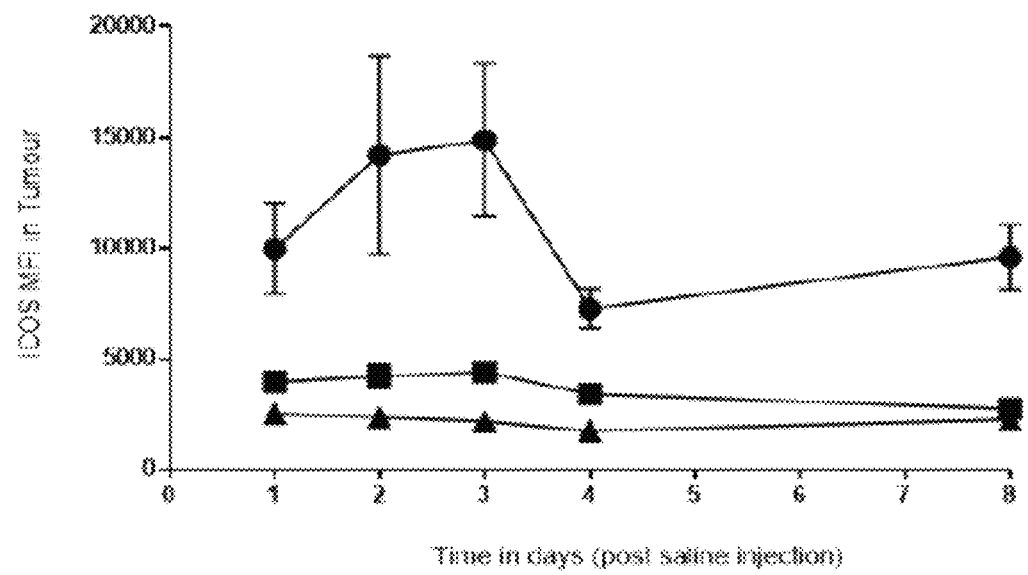
Figure 42F:
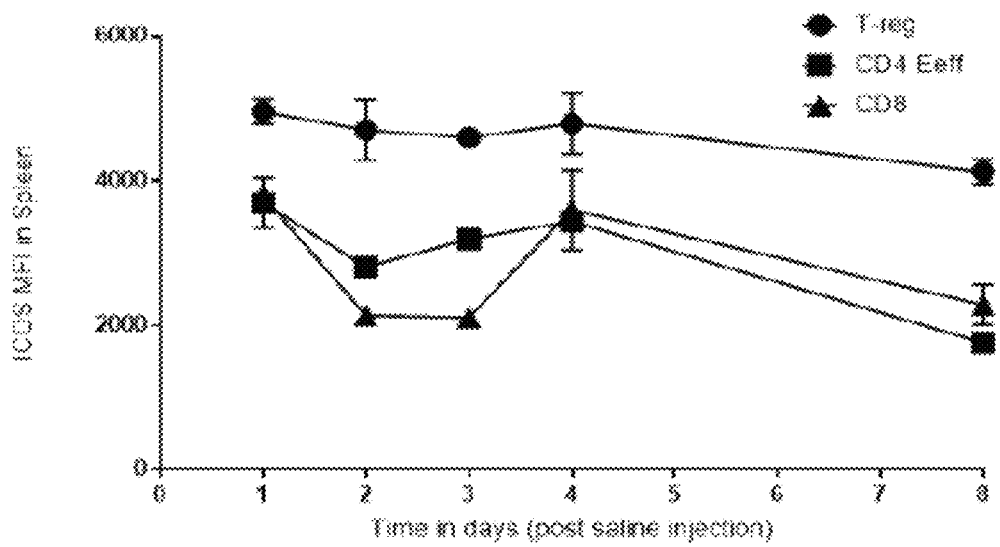
Figure 42G:
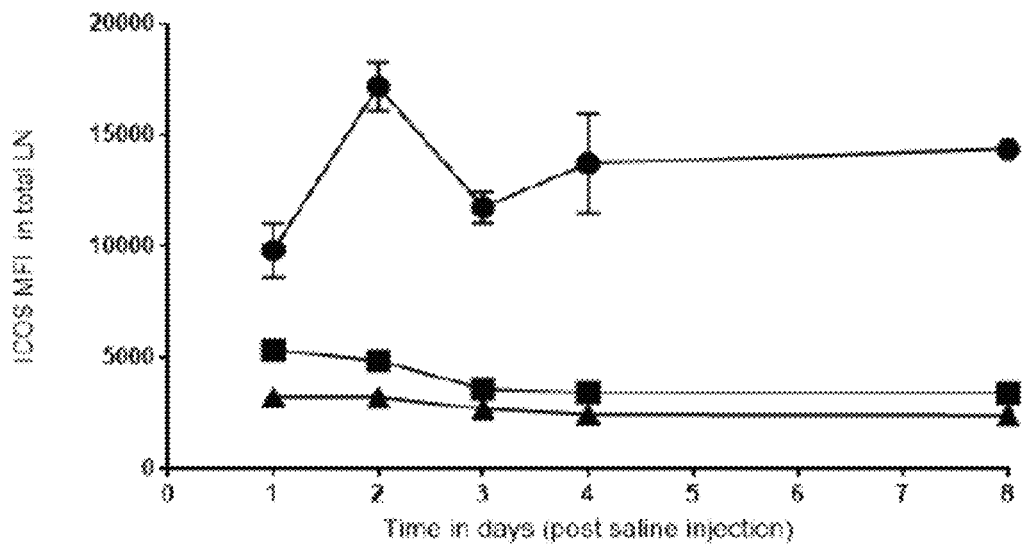
Figure 42H:
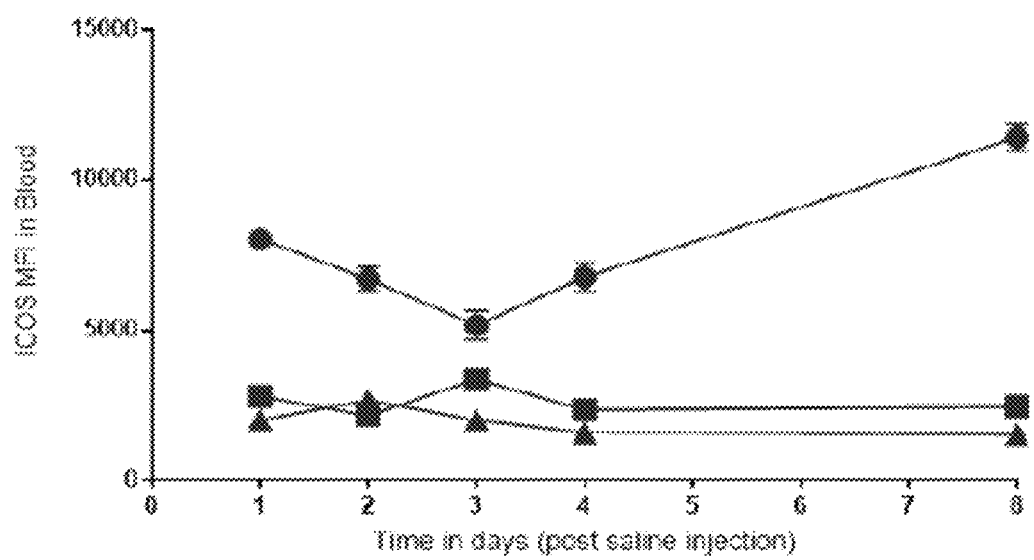

Hazard Ratio (Mantel-Haenszel) values and their associated P values (Log-Rank Mantel-Cox) corresponding to FIG. 41 Kaplan-Meier curves.

| Hazard Ratio (Mantel-Haenszel) | MD vs Saline | SD vs Saline | MD vs SD |
|---|---|---|---|
| Ratio (and its reciprocal) | 0.09995 | 0.1076 | 0.5314 |
| 95% CI of ratio | 0.02604 to 0.3837 | 0.02856 to 0.4052 | 0.05522 to 5.115 |
| P Value | 0.0008 | 0.001 | 0.5842 |

Example 24: Time and Dose Dependent Effects of Anti-ICOS Antibody in CT-26 Tumour Bearing Animals This Example presents the results of a pharmacodynamic study evaluating the effects of anti-ICOS antibody on immune cells in mice bearing CT-26 tumours. T and B cell subtypes from different tissues were analysed by FACS after a single dose of STIM003 mIgG2a.

Methods

CT-26 tumour bearing animals were dosed i.p. with either saline or STIM003 at 200 μg, 60 μg or 6 μg on day 12 post tumour cell implantation. Tumour tissues, blood, tumour draining lymph node (TDLN) and spleen were harvested on day 1, 2, 3, 4, and day 8 post treatment. The tumours were dissociated to make single cell suspension using mouse tumour dissociation kit (Miltenyi Biotec). Spleen tissue was dissociated using gentle MACS dissociation, red blood cells were lysed using RBC lysis buffer. Tumour draining lymph nodes were mechanically disaggregated to make single cells suspensions. The resulting cell suspensions were clarified through either 70 μM or 40 μM filters depending on the tissue, cells were then washed twice in RMPI complete media and finally resuspended in ice cold FACS buffer. Total blood was collected into plasma tubes and red blood cells were lysed using RBC lysis buffer, cells were washed twice in RMPI complete media and finally resuspended in ice cold FACS buffer. The single cell suspension from all the tissues were distributed into 96 deep well plates for FACS analysis. Cells were stained with Live Dead Fixable Yellow viability dye (Life technologies). The cell suspensions were incubated with anti-CD16/CD32 mAb (eBioscience) and stained with FACS antibodies specific for CD3 (17A2), CD45 (30-F11), CD4 (RM4-5), CD8 (53-6.7), CD25 (PC61.5), ICOSL (HK5.3), B220 (RA3-6B2), Ki-67 (SolA15), CD107a (eBio1D4B), IFN-γ (XMG1.2), TNF-α (MP6-XT22), Foxp3 (FJK-16s) and ICOS (7E.17G9) all obtained from eBioscience Ltd. For cytokine readout by FACS, single cells suspensions from the tumours were plated in 24 well plate for 4 hours in the presence of Brefeldin-A. For the intracellular staining, samples were fixed, permeabilised, and stained with specific antibodies. The samples were finally resuspended in PBS and data acquired on the Attune flow cytometer (Invitrogen) and analysed using FlowJo V10 software (Treestar).

Results are presented and discussed below.

ICOS Expression is High on Intra-Tumoral T-Regs in the CT26 Model

When the percentage of tumour infiltrating lymphocytes (TILs) expressing ICOS was compared to the percentage of immune cells in the spleen, blood, and TDLN, we demonstrated that more immune cells in the microenvironment of CT-26 tumours expressed ICOS vs other tissues. More importantly, the percentage of ICOS positive T-reg cells in all the tissues and at all the time points was higher than the percentage of CD4 or CD8 effector T cells positive for ICOS. Importantly, the dMFI (relative expression) for ICOS also followed the similar ranking in expression with intratumoural T-reg being highly positive for ICOS expression vs other TILs subtypes. Interestingly, there was no striking change in the percentage of ICOS$^+$ TILs within the time frame of this experiment. Similar results were also seen in spleen and TDLN. On the other hand, in the blood, ICOS expression is relatively stable on T effector cells but increased on T-regs during the course of the experiment. Altogether the data demonstrated that more cells expressed ICOS in the tumour microenvironment and these positive cells also expressed more ICOS molecules on their surface. More importantly, T regs in TILs are highly positive for ICOS. See FIG. 42.

Figure 43A:
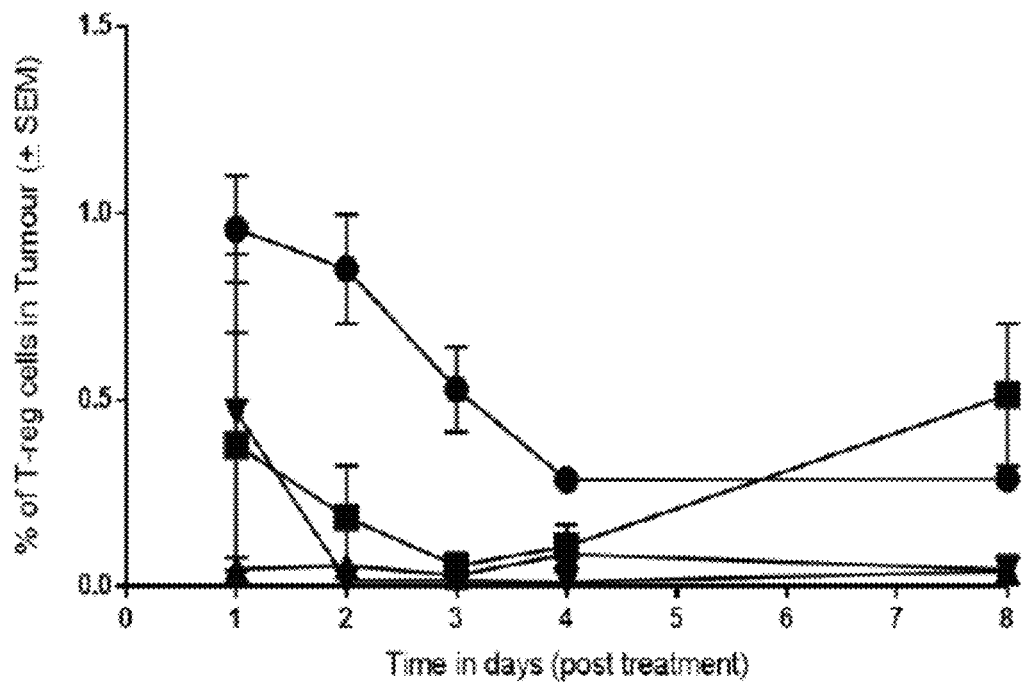
FIG. 43A and FIG. 43B: FACS analysis demonstrating T-reg depletion in the TME in response to STIM003 mIgG2a antibody. CT-26 tumour bearing animals were treated with a single dose (6, 60 or 200 μg) of STIM003 on day 12 post tumour cell implantation. Tissues (n=4 per time point) where harvested for FACS analysis on day 1, 2, 3, 4 and 8 post treatment. The percentage of T-reg cells (CD4$^+$CD25$^+$Foxp3$^+$) in total tumour (FIG. 43A) and the percentage of T-reg cells in the blood (FIG. 43B) are shown at the different time points. See Example 24.
Figure 43B:
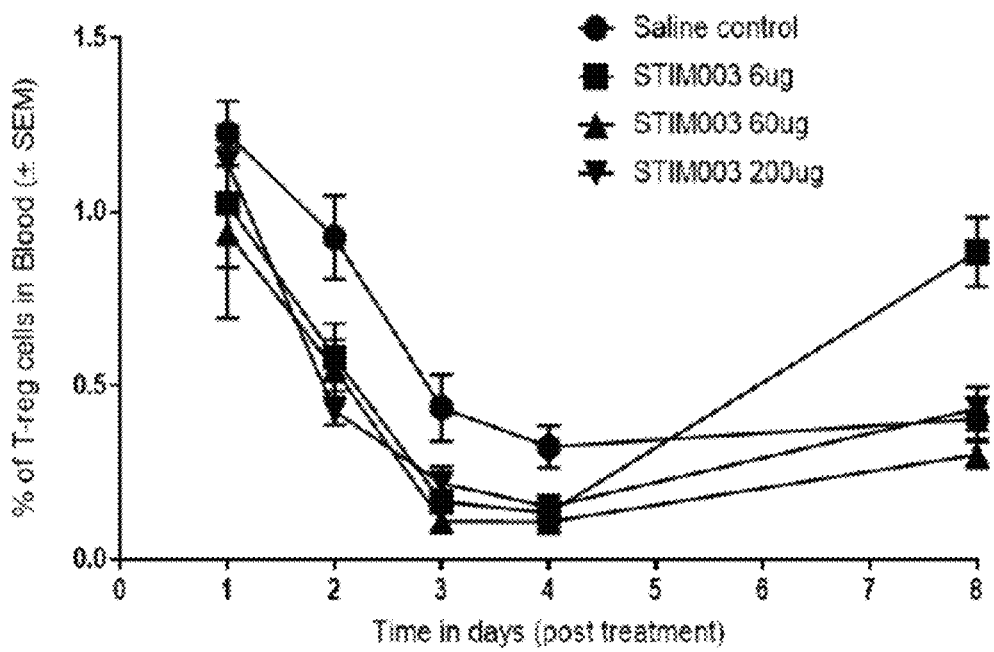
Figure 44A:
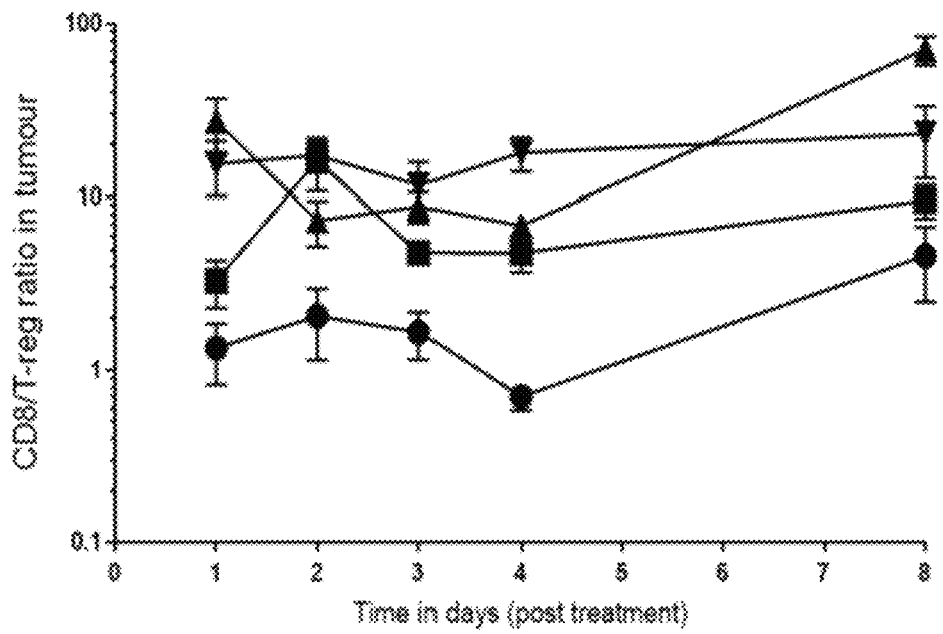
FIG. 44A, FIG. 44B, FIG. 44C, and FIG. 44D: Increase in CD8:T-reg and CD4 eff:T-reg ratio in response to STIM003 mIgG2a. CT-26 tumour bearing animals received a single dose (6, 60 or 200 μg) of STIM003 mIgG2a on day 12 post tumour cell implantation. Tissues (n=4 per time point) were harvested for FACS analysis on day 1, 2, 3, 4 and 8 post treatment and T eff to T-reg ratios were calculated.
Figure 44B:
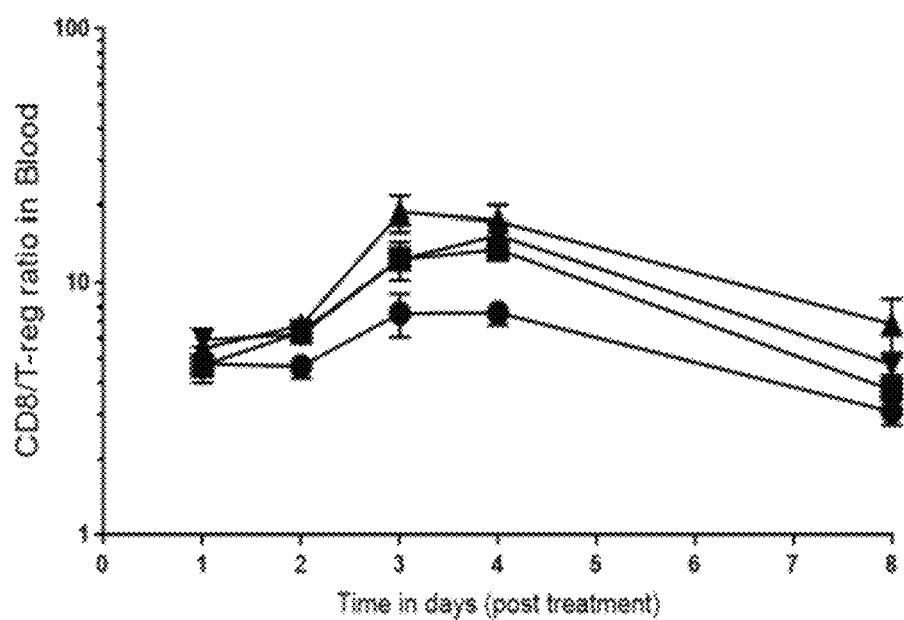
Figure 44C:
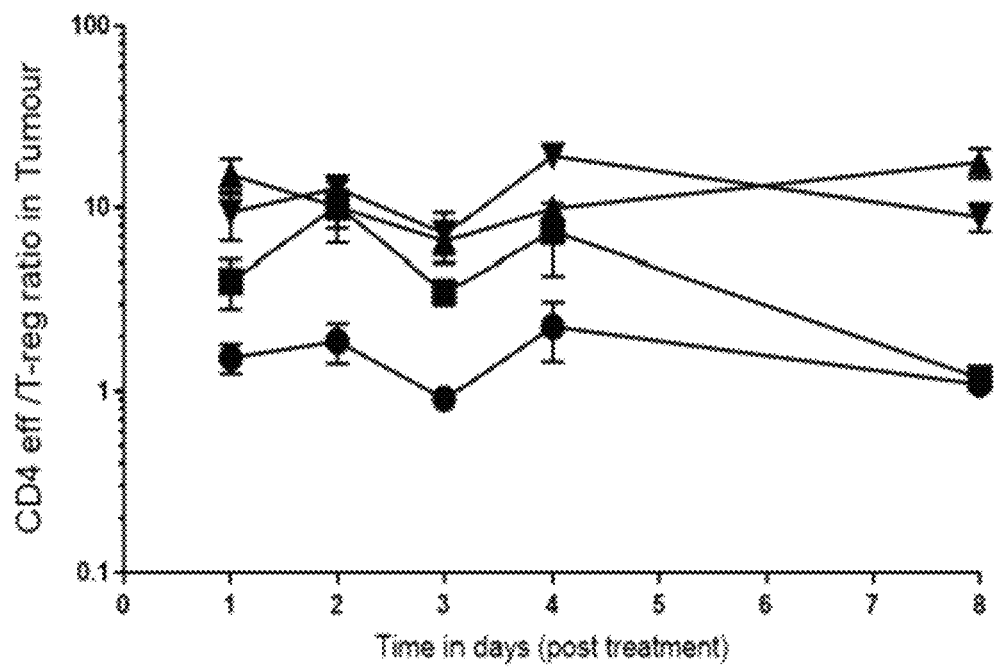
Figure 44D:
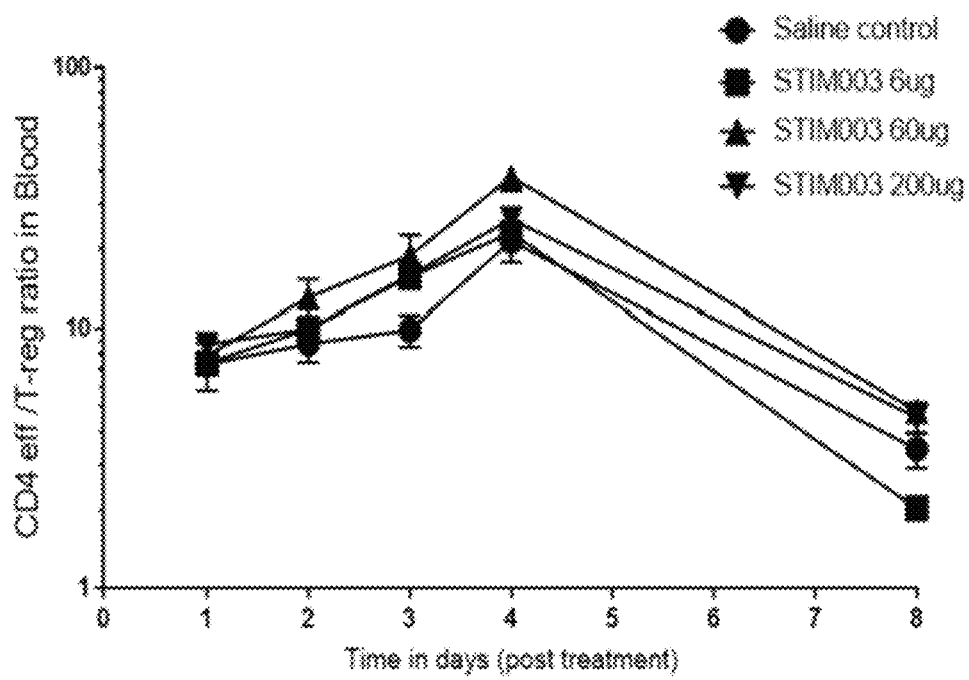
Figure 45A:
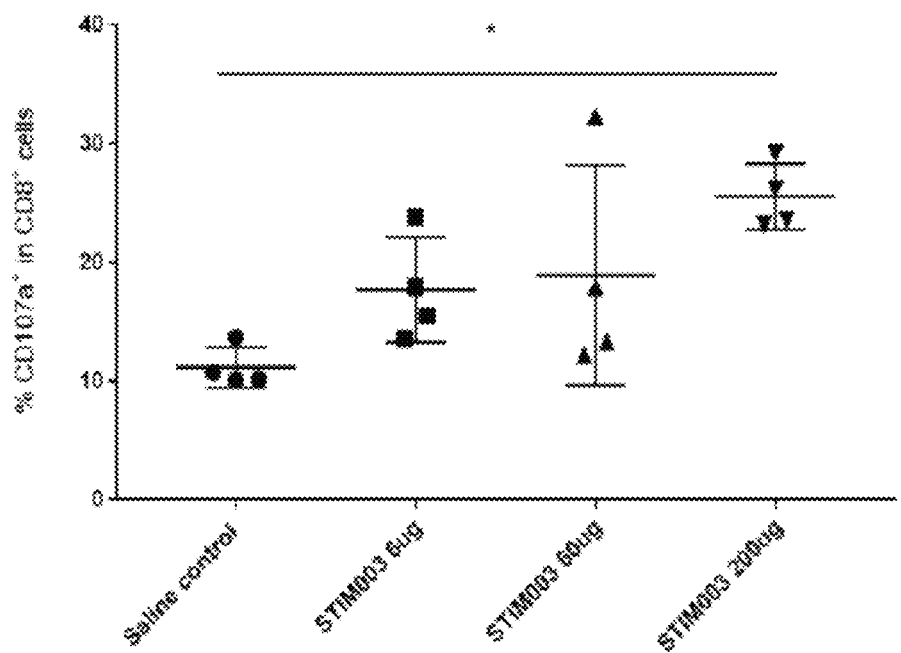
FIG. 45A, FIG. 45B, FIG. 45C, FIG. 45D, FIG. 45E, FIG. 45F, FIG. 45G, and FIG. 45H: STIM003 treatment correlates with increased degranulation and Th1 cytokine production by TILs. On day 8 post treatment TILs were isolated and FACS analysis were performed to detect CD107a expression on CD4 and CD8 T cells (FIG. 45A and FIG. 45B). In parallel, cells from dissociated tumours were rested for 4 hrs in the presence of Brefeldin-A, cells were stained for T cells markers and permeabilised for intracellular staining to detect IFN-γ and TNF-α (FIG. 45C, FIG. 45D, FIG. 45E, FIG. 45F, FIG. 45G, and FIG. 45H). See Example 24.
Figure 45B:
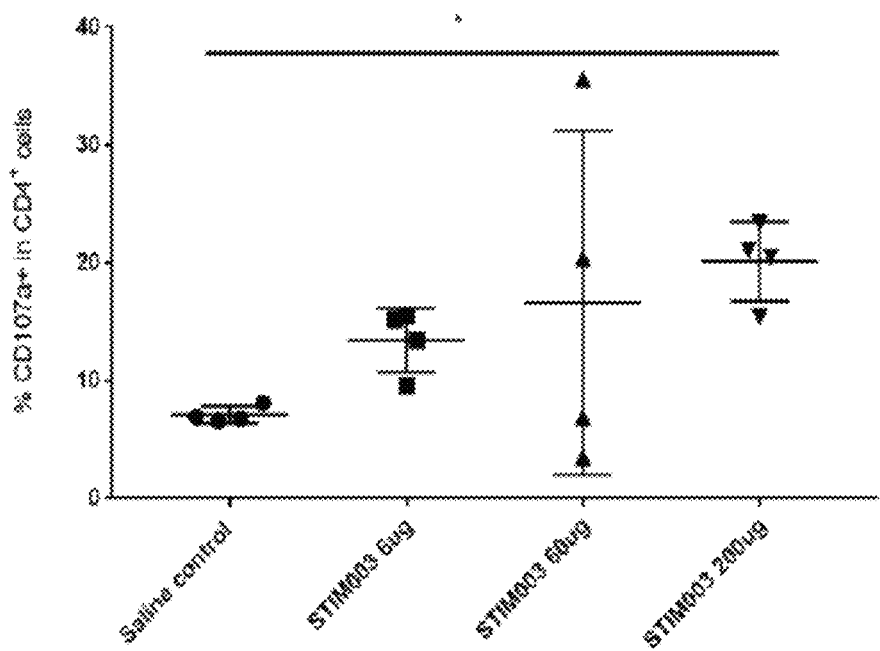
Figure 45C:
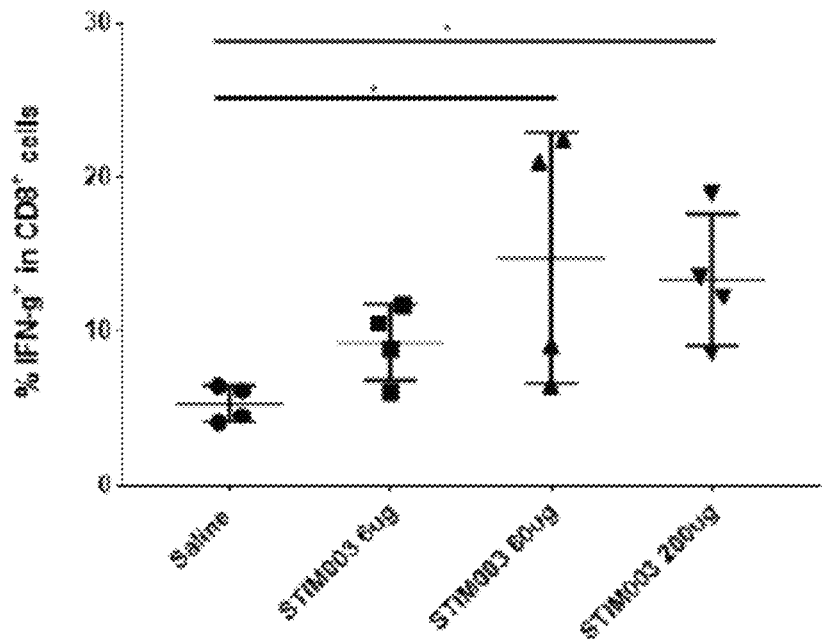
Figure 45D:
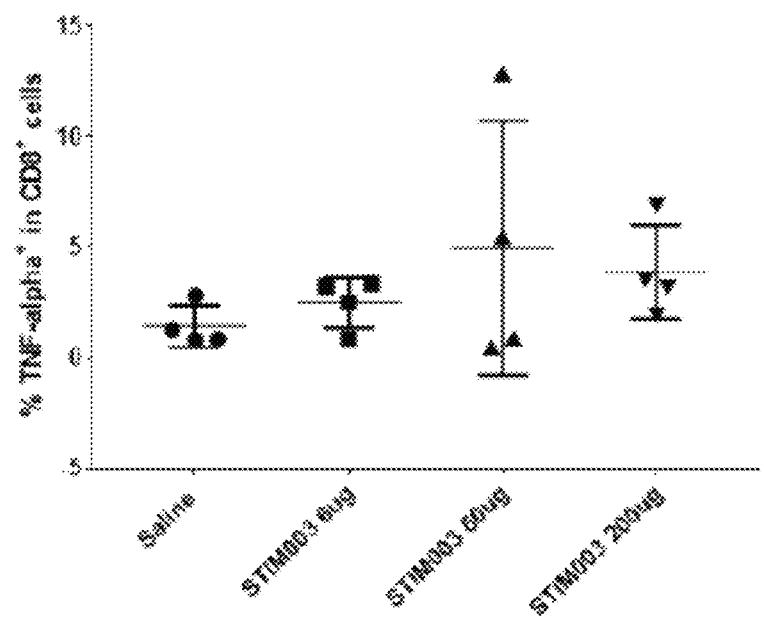
Figure 45E:
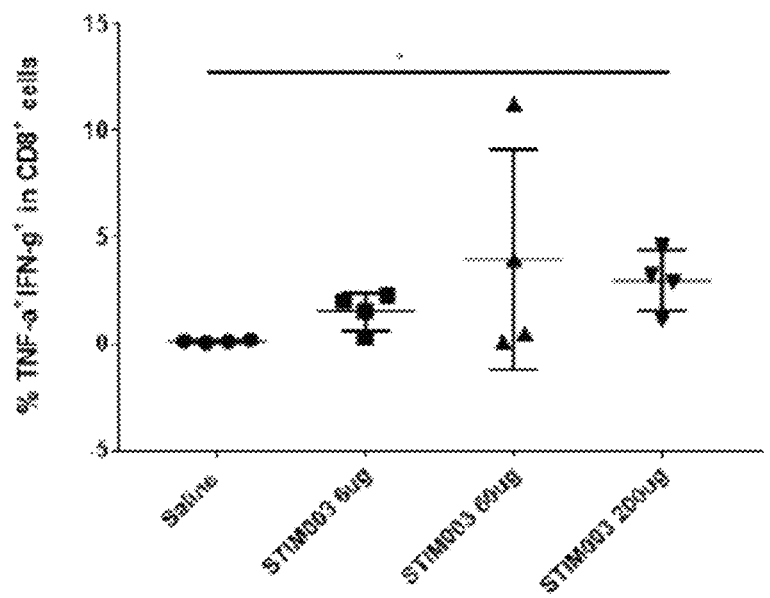
Figure 45F:
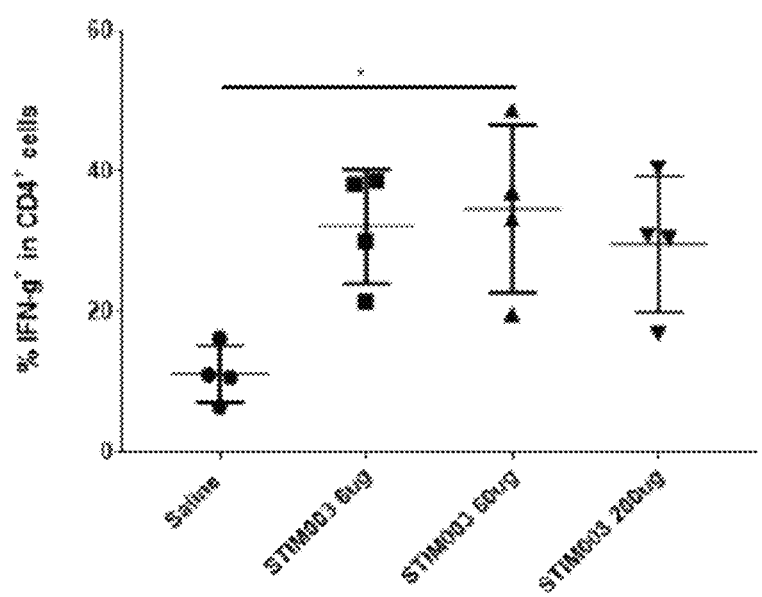
Figure 45G:
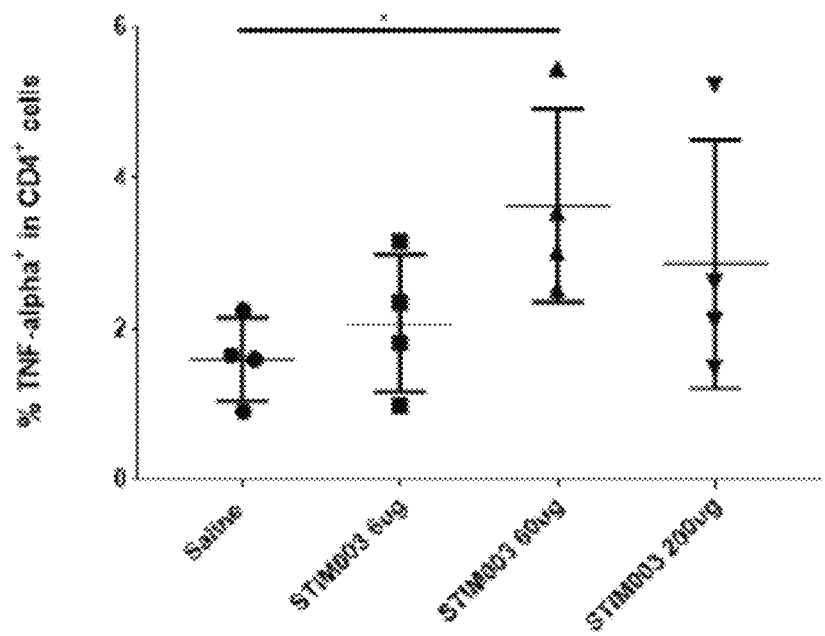
Figure 45H:
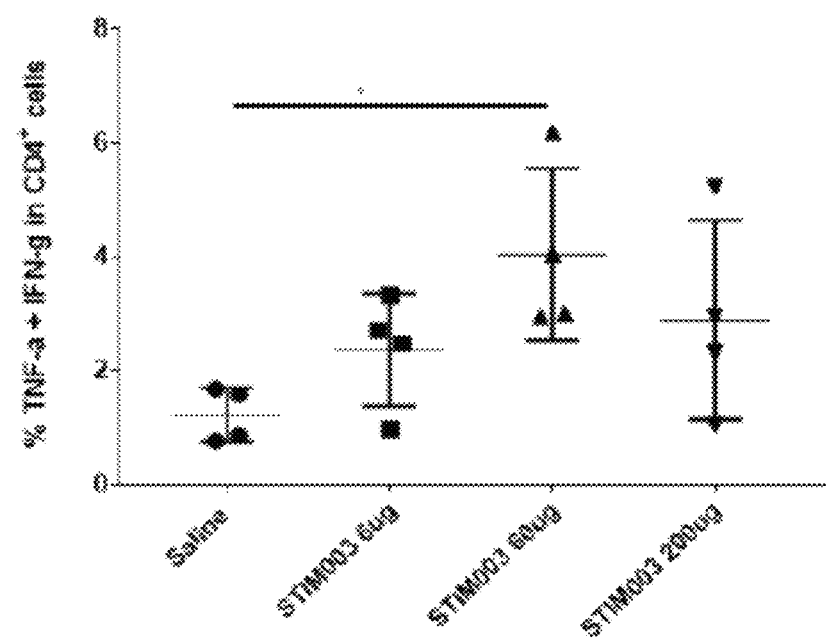

Strong Depletion of Intra-Tumoural T-Reg Cells in Response to STIM003 Administration In response to the STIM003 mIgG2a antibody, there was strong and rapid depletion of T-reg cells (CD4+CD25+ Foxp3) in TME. As T-regs have high ICOS expression compared with the other T cells subsets, it is expected that an anti-ICOS antibody with effector function would preferentially deplete these cells. At the lower dose of STIM003 (6 µg corresponding to a 0.3 mg/kg for a 20 g animal) there was a continuous depletion of T-reg and by day 3 most of the T-reg were depleted from TME. Interestingly, by day 8, T-reg cells repopulate the TME then reach a level slightly above that observed in the saline treated animals. The repopulation of T-reg cells at lower dose can be attributed to the increase in the proliferating CD4 T cells in TME as evidenced by an observed increase in Ki-67+ CD4 T-cells. At a dose higher than 6 µg there was a long-term depletion of T-reg cells in TME as shown by full T Reg depletion until the last time point analysed in this study (day 8). Whereas in the blood there was a transient depletion of T-reg cells at all doses. Importantly, by day 8, all the treated animals had similar (or higher for the 6 µg dose) level of T-reg cells in the blood when compared to the saline treated animals. Data are shown in FIG. 43. Notably, and similarly to data previously published for depleting CTLA-4 antibodies, there was no significant change in the percentage of T-reg cells in the spleen or TDLN tissues, suggesting that T-reg cells may be protected from depletion in these organs.

In summary, strong depletion of T-reg cells in TME was achieved in CT-26 model at a dose as low as 6 µg per animal. However, a dose of 60 µg resulted in long term depletion up to 8 days post STIM003 mIgG2a injection. This was not improved by using higher dose (200 µg).

STIM003 mIgG2a Increased CD8:T Reg and CD4:T Reg Ratios

Effects of STIM003 on T-eff:T-reg ratios are shown in FIG. 44.

STIM003 mIgG2a increased the CD8:T-reg ratio as well as the CD4 eff:T-reg ratio. Although all the treatment doses were associated with an increase in T-eff to T-reg ratio, the intermediate dose of 60 µg (the equivalent of 3 mg/kg for a 20 g animals) was associated with the highest ratio by day 8 post treatment.

Interestingly, at the 6 µg dose, the ratios were high until day 4 but by day 8 post treatment they were matching that of the saline treated animals. This can be explained by the repopulation of TRegs observed for this dose by day 8 post treatment. On the other hand, at a dose of 60 or 200 µg, the Teff to T-reg ratios remained high at all time points. This is explained by a long term depeletion of Tregs at these doses. Notably, at higher dose (200 µg), despite the long term Treg depletion there was only a moderate improvement in the ratio by day 8. This can be explained by some depletion of ICOS$^{INT}$ effector cells at high concentration of STIM003.

Altogether, the data demonstrated TReg depletion and increased Effector:T reg ratio at all doses tested. However, an optimal dose of 60 µg (~3 mg/kg) achieved both a long-term depletion of T-reg, as well as the highest T-eff to T-reg ratios which would be associated with the most favourable immune context to initiate an anti-tumour immune response. Interestingly a similar pattern was observed in the blood, with the intermediate dose of 60 µg associated with the highest T-eff to T-reg ratio. Importantly, in the blood, improvement of the ratio was observed at an earlier time point (between day 3 and day 4).

Activation of Effector Cells in Response to STIM003

Surface expression of CD107a on the tumour infiltrating T effector cells was previously identified as a reliable marker for cells that have been activated and exert cytotoxic activity [44]. In the present study employed this marker to confirm that STIM003, in addition to depleting T-regs, can stimulate the cytotoxic activity of effector T cells in the TME. Interestingly, on day 8 post treatment, there was an increase in surface expression of CD107a on both the CD4 and CD8 effector T cell compartments at all doses of STIM003. Furthermore, this upregulation of CD107a expression on the surface on both CD4 and CD8 T cells appeared to plateau when animals were dosed at 60 µg as no improvement was seen at 200 µg dosing.

To further demonstrate activation of effector cells in the TME, the cytokine release by CD4 and CD8 TILs was analysed by FACS. As expected and consistent with the in-vitro agonism data presented in earlier Examples herein, STIM003 mIgG2a at all doses promoted pro-inflammatory cytokine IFN-γ and TNF-α production by effector CD4 and CD8 T cells. The induction of pro-inflammatory cytokine production appeared to be high at the optimum dose of 60 µg. Indeed, 60 µg of STIM003 significantly increased cytokine production by CD4 T cells. A similar trend was seen for the proinflammatory cytokine IFN-γ and TNF-α production by effector CD8 T cells in TME. Data are shown in FIG. 45.

In summary, STIM003 at all the doses resulted in T cells activation in the TME as shown by (1) the presence of the degranulation marker CD107a on their surface and (2) by the production of Th1 cytokines (IFNγ and TNFα) by T cells. This indicates that STIM003 strongly affects the immune context in the TME and plays the dual role of depleting Treg cells and stimulate the killing activity of T effector cells.

Human Dose Estimations

Based on the pre-clinical efficacy data seen in mice, initial predictions can be made of the clinical dose appropriate for human patients, based on corresponding biological surface area (BSA) [45].

For example, taking the optimal anti-ICOS IgG dose in mouse to be 3 mg/kg (60 µg), and following the methods of ref. [45], the corresponding dose for a human is 0.25 mg/kg.

Using the Mosteller formulae, for an individual of 60 kg and 1.70 m the BSA 1.68 m². Multiplying the dose in mg/kg by a factor of 35.7 (60/1.68) gives a fixed dose of 15 mg. For an individual of 80 kg the corresponding fixed dose would be 20 mg.

Doses may be optimised for human therapy in clinical trials to determine safe and effective treatment regimens.

Example 25: Bioinformatic Analysis of Data from Tumour Samples

One target group of cancers according to the present invention is those cancers that are associated with a relatively high level of ICOS+ immunosuppressive Tregs.

To identify cancer types associated with a high content of Tregs, transcriptome data was obtained from The Cancer Genome Atlas (TCGA) public dataset and analysed for ICOS and FOXP3 expression levels. TCGA is a large-scale study that has catalogued genomic and transcriptomic data accumulated for many different types of cancers, and includes mutations, copy number variation, mRNA and miRNA gene expression, and DNA methylation along with substantial sample metadata.

Gene Set enrichment analysis (GSEA) was conducted as follows. Gene expression RNA seq data collected as part of the TCGA consortium was downloaded from the UCSC Xena Functional Genomics Browser as log 2(normalized_count+1). Non-tumour tissue samples were removed from the dataset, leaving data for 20530 genes from 9732 samples. An algorithm from [46] and its implementation in [47] that calculates enrichment scores for genes within a specified gene set was used to transpose gene level counts to gene set scores for each sample. The gene set of interest was defined as containing both ICOS and FOXP3. Samples were grouped by primary disease and the ssGSEA scores for each group were compared across the 33 primary disease groups. The disease groups that showed the highest median scores were found to be lymphoid neoplasm diffuse large b-cell lymphoma, thymoma, head and neck squamous cell carcinoma, although diffuse large b-cell lymphoma showed a multimodal distribution of scores with a subset scoring highly and the rest scoring below the group median.

In rank order of highest to lowest ssGSEA score for ICOS and FOXP3 expression, the top 15 cancer types were:

| | |
|---|---|
| DLBC (n = 48) | lymphoid neoplasm diffuse large b-cell lymphoma |
| THYM (n = 120) | thymoma |
| HNSC (n = 522) | head and neck squamous cell carcinoma |
| TGCT (n = 156) | testicular germ cell tumour |
| STAD (n = 415) | stomach adenocarcinoma |
| SKCM (n = 473) | skin cutaneous melanoma |
| CESC (n = 305) | cervical squamous cell carcinoma and endocervical adenocarcinoma |
| LUAD (n = 517) | lung adenocarcinoma |
| LAML (n = 173) | acute myeloid leukemia |
| ESCA (n = 185) | esophageal carcinoma |
| LUSC (n = 502) | lung squamous cell carcinoma |
| READ (n = 95) | rectum adenocarcinoma |
| COAD (n = 288) | colon adenocarcinoma |
| BRCA (n = 1104) | breast invasive carcinoma |
| LIHC (n = 373) | liver hepatocellular carcinoma |

In which n is the number of patient samples for that cancer type in TCGA dataset. Anti-ICOS antibodies described herein may be used for treatment of these and other cancers.

Cancers that are associated with a relatively high level of ICOS+ immunosuppressive Tregs and which further express PD-L1 may respond especially well to treatment with a combination of anti-ICOS antibody and anti-PD-L1 antibody. Appropriate treatment regiments and antibodies for this purpose have already been detailed in the foregoing description.

Using the TCGA dataset as before, enrichment scores for ICOS and FOXP3 were correlated with expression levels of PD-L1 using Spearman's rank correlation and grouped by primary disease indication. P-values were calculated for each group and a p-value of 0.05 (with Bonferroni's multiple comparison correction) was taken as statistically significant. The disease groups with the highest correlations between ICOS/FOXP3 and PD-L1 expression were:

| | |
|---|---|
| TGCT (n = 156) | testicular germ cell tumour |
| COAD (n = 288) | colon adenocarcinoma |
| READ (n = 95) | rectum adenocarcinoma |
| BLCA (n = 407) | bladder urothelial carcinoma |
| OV (n = 308) | ovarian serous cystadenocarcinoma |
| BRCA (n = 1104) | breast invasive carcinoma |
| SKCM (n = 473) | skin cutaneous melanoma |
| CESC (n = 305) | cervical squamous cell carcinoma and endocervical adenocarcinoma |
| STAD (n = 415) | stomach adenocarcinoma |
| LUAD (n = 517) | lung adenocarcinoma |

Patients may be selected for treatment following an assay determining that their cancer is associated with ICOS+ immunosuppressive Tregs and expression of PD-L1. For cancer types in which, as above, there is a high correlation score, it may suffice to determine that one of ICOS+ immunosuppressive Tregs and expression of PD-L1 is present (e.g., above a threshold value). PD-L1 immunohistochemistry assays may be used in this context.

Example 26: Assessment of Further Anti-ICOS Antibodies

CL-74570 and CL-61091 antibody sequences identified in Example 12 were synthesised and expressed in IgG1 format in HEK cells.

Functional characterisation of these antibodies was performed using an HTRF assay similar to that described in Example 6, with modifications to adapt the assay to use of purified IgG1 rather than BCT supernatant. 5 µL of supernatant containing human IgG1 antibodies expressed from HEK cells was used in place of the BCT supernatant, and the total volume made up to 20 µl per well using HTRF buffer as before. A human IgG1 antibody was used as a negative control. Both antibodies exhibited greater than 5% effect for binding to human and mouse ICOS as calculated using Equation 1 and were therefore confirmed to test positive in this assay.

Ability of these antibodies to bind human and mouse ICOS expressed on the surface of CHO-S cells was further confirmed using a Mirrorball assay. In this assay, 5 µl supernatant containing the anti-ICOS IgG1 was transferred to each well of 384 mirrorball black plates (Corning). Binding of anti-ICOS antibodies was detected by adding 10 µl of goat anti-human 488 (Jackson Immunoresearch) diluted in assay buffer (PBS+1% BSA+0.1% Sodium Azide) at a concentration of 0.8 mg/ml to all wells.

For positive control wells, 5 µL reference antibody diluted in assay media to 2.2 µg/mL was added to the plates. For negative control wells, 5 µl of Hybrid control IgG1 diluted in assay media to 2.2 µg/mL was added to the plates. 10 µM of DRAQ5 (Thermoscientific) was added to $0.4 \times 10^6$/ml cells resuspended in assay buffer and 5 µl was added to all wells. Plates were incubated for 2 hr at 4 degrees.

Fluorescence intensity was measured using Mirrorball plate reader (TTP Labtech), measuring Alexafluor 488 (excitation 493 nm, emission 519 nm) from a population of 500-700 single cells. Assay signal was measured as Median (FL2) Mean Intensity.

Total binding was defined using reference antibody at an assay concentration of 2.2 µg/mL. Non-specific binding was defined using Hybrid control hIgG1 at an assay concentration of 2.22 µg/mL. Both antibodies exhibited greater than 1 percent effect and were therefore confirmed to test positive in this assay.

$$\text{Percent effect} = \frac{(\text{sample well} - \text{non-specific binding})}{(\text{total binding} - \text{non-specific binding})} \times 100$$

Each of CL-74570 and CL-61091 also demonstrated binding to human and mouse ICOS expressed on CHO-S cells as determined by flow cytometry. FACS screening was performed using a method similar to that described in Example 6, with modifications to adapt the assay to use of purified IgG1 rather than BCT supernatant. Both antibodies exhibited binding >10 fold above the average of geomean of the negative control binding to hICOS, mICOS and WT CHO cells.

TABLE E26-1

Functional characterisation of CL-74570 and CL-61091.

| Primary Screen | | | | Secondary screen | | |
|---|---|---|---|---|---|---|
| HTRF (Protein) | | Mirrorball (ICOS CHO Cell) | | FACS | | |
| Human 1:100 dil Percent Effect [%] | Mouse 1:100 dil Percent Effect [%] | Human 1:100 dil Percent Effect [%] | Mouse 1:100 dil Percent Effect [%] | Human ICOS CHO (1:10 dil) % Binding-APC | Mouse ICOS CHO (1:10 dil) % Binding-APC | Clone ID |
| 94.42 | 60.86 | 107.02 | 127.03 | 122.97 | 96.41 | CL-74570 |
| 83.43 | 76.65 | 54.14 | 113.10 | 19.08 | 62.94 | CL-61091 |

REFERENCES

1 Hutloff A, et al. ICOS is an inducible T-cell co-stimulator structurally and functionally related to CD28. Nature. 1999 Jan. 21; 397(6716):263-6.
2 Beier K C, et al. Induction, binding specificity and function of human ICOS. Eur J Immunol. 2000 December; 30(12):3707-17.
3 Coyle A J, et al. The CD28-related molecule ICOS is required for effective T cell-dependent immune responses. Immunity. 2000 July; 13(1):95-105.
4 Dong C, et al. ICOS co-stimulatory receptor is essential for T-cell activation and function. Nature. 2001 Jan. 4; 409 (6816):97-101.
5 Mak T W, et al. Costimulation through the inducible costimulator ligand is essential for both T helper and B cell functions in T cell-dependent B cell responses. Nat Immunol. 2003 August; 4(8):765-72.
6 Swallow M M, Wallin J J, Sha W C. B7h, a novel costimulatory homolog of B7.1 and B7.2, is induced by TNFalpha. Immunity. 1999 October; 11(4):423-32.
7 Wang S, et al. Costimulation of T cells by B7-H2, a B7-like molecule that binds ICOS. Blood. 2000 Oct. 15; 96(8):2808-13.
8 Conrad C, Gilliet M. Plasmacytoid dendritic cells and regulatory T cells in the tumor microenvironment: A dangerous liaison. Oncoimmunology. 2013 May 1; 2(5): e2388.
9 Simpson et al., Fc-dependent depletion of tumor-infiltrating regulatory T cells co-defines the efficacy of anti-CTLA-4 therapy against melanoma. J. Exp. Med. 210(9): 1695-1710 2013
10 Fu T, He Q, Sharma P. The ICOS/ICOSL pathway is required for optimal antitumor responses mediated by anti-CTLA-4 therapy. Cancer Res. 2011 Aug. 15; 71(16): 5445-54.
11 Fan X, Quezada S A, Sepulveda M A, Sharma P, Allison J P. Engagement of the ICOS pathway markedly enhances efficacy of CTLA-4 blockade in cancer immunotherapy. J Exp Med. 2014 Apr. 7; 211(4):715-25.
12 Carthon, B. C., et al. Preoperative CTLA-4 blockade: Tolerability and immune monitoring in the setting of a presurgical clinical trial. Clin. Cancer Res. 16:2861-2871.
13 Liakou C I, et al. CTLA-4 blockade increases IFNgamma-producing CD4+ICOShi cells to shift the ratio of effector to regulatory T cells in cancer patients. Proc Natl Acad Sci USA. 2008 Sep. 30; 105(39):14987-92.
14 Vonderheide, R. H., et al. 2010. Tremelimumab in combination with exemestane in patients with advanced breast cancer and treatment-associated modulation of inducible costimulator expression on patient T cells. Clin. Cancer Res. 16:3485-3494.
15 Preston C C, et al., The ratios of CD8+ T cells to CD4+CD25+FOXP3+ and FOXP3− T cells correlate with poor clinical outcome in human serous ovarian cancer. PLoS One November 14; 8(11):e80063.
16 Hodi F S, et al., Immunologic and clinical effects of antibody blockade of cytotoxic T lymphocyte-associated antigen 4 in previously vaccinated cancer patients. PNAS 2008 Feb. 26; 105(8):3005-10
17 Chattopadhyay et al., Structural Basis of Inducible Costimulatory Ligand Function: Determination of the Cell Surface Oligomeric State and Functional Mapping of the Receptor Binding Site of the Protein, J. Immunol. 177(6):3920-3929 2006
18 Lefranc M P, IMGT unique numbering for immunoglobulin and T cell receptor variable domains and Ig superfamily V-like domains, Dev Comp Immunol. 27(1):55-77 2003
19 Gül et al., "Antibody-Dependent Phagocytosis of Tumor Cells by Macrophages: A Potent Effector Mechanism of Monoclonal Antibody Therapy of Cancer", Cancer Res., 75(23), Dec. 1, 2015
20 Lazar et al., 2006, Proc. Natl. Acad. Sci. U.S.A., March 14; 103(11):4005-10
21 Dall et al., Immunol 2002; 169:5171-5180
22 Natsume et al., 2009, Drug Des. Devel. Ther., 3:7-16 or by Zhou Q., Biotechnol. Bioeng., 2008, February 15, 99(3):652-65)
23 Shields et al., 2001, J. Biol. Chem., March 2; 276(9): 6591-604)
24 Idusogie et al., J. Immunol., 2001, 166:2571-2575
25 Natsume et al., 2008, Cancer Res., 68: 3863-3872
26 Alexandrov L B, et al. Signatures of mutational processes in human cancer. Nature. 2013 Aug. 22; 500(7463):415-21
27 Martin-Orozco et al., Melanoma Cells Express ICOS Ligand to Promote the Activation and Expansion of T-Regulatory Cells, Cancer Research 70(23):9581-9590 2010

28 Houot et al., Therapeutic effect of CD137 immunomodulation in lymphoma and its enhancement by Treg depletion, Blood 114:3431-3438 2009
29 Baruch K. et al. PD-1 immune checkpoint blockade reduces pathology and improves memory in mouse models of Alzheimer's disease. Nat Med 22(2):137-137 2016
30 Curran et al., PD01 and CTLA-4 combination blockade expands infiltrating T cells and reduces regulatory T and myeloid cells within B16 melanoma tumours, PNAS 107(9):4275-4280 2010
31 Sim et al., IL-2 therapy promotes suppressive ICOS+ Treg expansion in melanoma patients, J Clin Invest 2014
32 Sim et al., IL-2 variant circumvents ICOS+ regulatory T cell expansion and promotes NK cell activation, Cancer Immunol Res 2016
33 Kroemer et al. Immunologic Cell Death in Cancer Therapy, Ann Rev Immunol. 31:51-72 2013
34 Galluzzi, Zitvogel & Kroemer Canc. Imm. Res. 4:895-902 2016
35 Bos et al., Transient regulatory T cell ablation deters oncogene-driven breast cancer and enhances radiotherapy, J Exp Med 210(11):2434-2446 2013
36 Sato et al., Spatially selective depletion of tumor-associated regulatory T cells with near-infrared photoimmunotherapy, Science Translational Medicine 8(352) 2016
37 Crotty S. T follicular helper cell differentiation, function, and roles in disease. Immunity. 2014 Oct. 16; 41(4):529-42.
38 Shields et al. (2002) JBC 277:26733
39 Lee et al, Nature Biotechnology, 32:6-363, 2014
40 Yusa K, Zhou L, Li M A, Bradley A, Craig N L. A hyperactive piggyBac transposase for mammalian applications, Proc Natl Acad Sci USA. 2011 Jan. 25
41 Kilpatrick et al., Rapid development of affinity matured monoclonal antibodies using RIMMS; Hybridoma; 16(4): 381-9 Aug. 1997
42 Simpson, T. R. et al., Fc-dependent depletion of tumor-infiltrating regulatory T cells co-defines the efficacy of anti-CTLA-4 therapy against melanoma. The Journal of experimental medicine, 210(9):1695-710 2013
43 Selby, M. J. et al., Anti-CTLA-4 antibodies of IgG2a isotype enhance antitumor activity through reduction of intratumoral regulatory T cells. Cancer immunology research, 1(1):32-42 2013.
44 Rubio V., et al. Ex vivo identification, isolation and analysis of tumor-cytolytic T cells. Nat Med. 2003 November; 9(11):1377-82.
45 Nair & Jacob., A simple practice guide for dose conversion between animals and human. J Basic Clin Pharma 2016; 7:27-31
46 D. A. Barbie, et al., "Systematic RNA interference reveals that oncogenic KRAS-driven cancers require TBK1.," Nature, vol. 462, no. 7269, pp. 108-12, 2009
47 S. Hänzelmann, R. Castelo, and J. Guinney, "GSVA: gene set variation analysis for microarray and RNA-Seq data," BMC Bioinformatics, vol. 14, no. 1, p. 7, 2013

```
Sequences

Antibody STIM001
VH domain nucleotide sequence: SEQ ID NO: 367
CAGGTTCAGGTGGTGCAGTCTGGAGCTGAGGTGAAGAAGCCTGGGGCCTCAGTGAAGGTCTCCTGCAAGGCTTCTGG
TTACACCTTTTCCACCTTTGGTATCACCTGGGTGCGACAGGCCCCTGGACAAGGGCTTGAATGGATGGGATGGATCA
GCGCTTACAATGGTGACACAAACTATGCACAGAATCTCCAGGGCAGAGTCATCATGACCACAGACACATCCACGAGC
ACAGCCTACATGGAGCTGAGGAGCCTGAGATCTGACGACACGGCCGTTTATTACTGTGCGAGGAGCAGTGGCCACTA
CTACTACTACGGTATGGACGTCTGGGGCCAAGGGACCACGGTCACCGTCTCCTCA
VH domain amino acid sequence: SEQ ID NO: 366
QVQVVQSGAEVKKPGASVKVSCKASGYTFSTFGITWVRQAPGQGLEWMGWISAYNGDTNYAQNLQGRVIMTTDTSTS
TAYMELRSLRSDDTAVYYCARSSGHYYYYGMDVWGQGTTVTVSS
VH CDR1 amino acid sequence: GYTFSTFG SEQ ID NO: 363
VH CDR2 amino acid sequence: ISAYNGDT SEQ ID NO: 364
VH CDR3 amino acid sequence: ARSSGHYYYYGMDV SEQ ID NO: 365
VL domain nucleotide sequence: SEQ ID NO: 374
GATATTGTGATGACTCAGTCTCCACTCTCCCTGCCCGTCACCCCTGGAGAGCCGGCCTCCATCTCCTGCAGGTCTAG
TCAGAGCCTCCTGCATAGTAATGAATACAACTATTTGGATTGGTACCTGCAGAAGCCAGGGCAGTCTCCACAGCTCC
TGATCTTTTTGGGTTCTAATCGGGCCTCCGGGGTCCCTGACAGGTTCAGTGGCAGTGGATCAGGCACAGATTTTACA
CTGAAAATCACCAGAGTGGAGGCTGAGGATGTTGGAATTTATTACTGCATGCAATCTCTACAAACTCCGCTCACTTT
CGGCGGAGGGACCAAGGTGGAGATCAAA
VL domain amino acid sequence: SEQ ID NO: 373
DIVMTQSPLSLPVTPGEPASISCRSSQSLLHSNEYNYLDWYLQKPGQSPQLLIFLGSNRASGVPDRFSGSGSGTDFT
LKITRVEAEDVGIYYCMQSLQTPLTFGGGTKVEIK
VL CDR1 amino acid sequence: QSLLHSNEYNY SEQ ID NO: 370
VL CDR2 amino acid sequence: LGS SEQ ID NO: 371
VL CDR3 amino acid sequence: MQSLQTPLT SEQ ID NO: 372

Antibody STIM002
VH domain nucleotide sequence: SEQ ID NO: 381
CAGGTTCAACTGGTGCAGTCTGGAGGTGAGGTGAAGAAGCCTGGGGCCTCAGTGAAGGTCTCCTGCAAGGCTTCTGG
TTACACCTTTACCAGCTATGGTTTCAGCTGGGTGCGACAGGCCCCTGGACAAGGACTAGAGTGGATGGGATGGATCA
GCGCTTACAATGGTAACACAAACTATGCACAGAAGCTCCAGGGCAGAGTCACCATGACCACAGACACATCCACGAGC
ACAGCCTACATGGAGCTGAGGAGCTTGAGATCTGACGACACGGCCGTGTATTACTGTGCGAGATCTACGTATTTCTA
TGGTTCGGGGACCCTCTACGGTATGGACGTCTGGGGCCAAGGGACCACGGTCACCGTCTCCTCA
VH domain amino acid sequence: SEQ ID NO: 380
QVQLVQSGGEVKKPGASVKVSCKASGYTFTSYGFSWVRQAPGQGLEWMGWISAYNGNTNYAQKLQGRVTMTTDTSTS
TAYMELRSLRSDDTAVYYCARSTYFYGSGTLYGMDVWGQGTTVTVSS
VH CDR1 amino acid sequence: GYTFTSYG SEQ ID NO: 377
VH CDR2 amino acid sequence: ISAYNGNT SEQ ID NO: 378
VH CDR3 amino acid sequence: ARSTYFYGSGTLYGMDV SEQ ID NO: 379
VL domain nucleotide sequence: 388
GATATTGTGATGACTCAGTCTCCACTCTCCCTGCCCGTCACCCCTGGAGAGCCGGCCTCCATCTCCTGCAGGTCTAG
TCAGAGCCTCCTGCATAGTGATGGATACAACTGTTTGGATTGGTACCTGCAGAAGCCAGGGCAGTCTCCACAGCTCC
TGATCTATTTGGGTTCTACTCGGGCCTCCGGGTTCCCTGACAGGTTCAGTGGCAGTGGATCAGGCACAGATTTTACA
```

| Sequences |
|---|
| CTGAAAATCAGCAGAGTGGAGGCTGAGGATGTTGGGGTTTATTACTGCATGCAAGCTCTACAAACTCCGTGCAGTTT<br>TGGCCAGGGGACCAAGCTGGAGATCAAA<br>Corrected STIM002 VL domain nucleotide sequence: SEQ ID NO: 519<br>GATATTGTGATGACTCAGTCTCCACTCTCCCTGCCCGTCACCCCTGGAGAGCCGGCCTCCATCTCCTGCAGGTCTAG<br>TCAGAGCCTCCTGCATAGTGATGGATACAACTATTTGGATTGGTACCTGCAGAAGCCAGGGCAGTCTCCACAGCTCC<br>TGATCTATTTGGGTTCTACTCGGGCCTCCGGGTTCCCTGACAGGTTCAGTGGCAGTGGATCAGGCACAGATTTTACA<br>CTGAAAATCAGCAGAGTGGAGGCTGAGGATGTTGGGGTTTATTACTGCATGCAAGCTCTACAAACTCCGCTCAGTTT<br>TGGCCAGGGGACCAAGCTGGAGATCAAA<br>VL domain amino acid sequence: SEQ ID NO: 387<br>DIVMTQSPLSLPVTPGEPASISCRSSQSLLHSDGYNYLDWYLQKPGQSPQLLIYLGSTRASGFPDRFSGSGSGTDFT<br>LKISRVEAEDVGVYYCMQALQTPLSFGQGTKLEIK<br>VL CDR1 amino acid sequence: QSLLHSDGYNY SEQ ID NO: 384<br>VL CDR2 amino acid sequence: IGS SEQ ID NO: 385<br>VL CDR3 amino acid sequence: MQALQTPLS SEQ ID NO: 386<br><br>Antibody STIM002-B<br>VH domain nucleotide sequence: SEQ ID NO: 395<br>CAGGTTCAACTGGTGCAGTCTGGAGGTGAGGTGAAGAAGCCTGGGGCCTCAGTGAAGGTCTCCTGCAAGGCTTCTGG<br>TTACACCTTTACCAGCTATGGTTTCAGCTGGGTGCGACAGGCCCCTGGACAAGGACTAGAGTGGATGGGATGGATCA<br>GCGCTTACAATGGTAACACAAACTATGCACAGAAGCTCCAGGGCAGAGTCACCATGACCACAGACACATCCACGAGC<br>ACAGCCTACATGGAGCTGAGGAGCTTGAGATCTGACGACACGGCCGTGTATTACTGTGCGAGATCTACGTATTTCTA<br>TGGTTCGGGGACCCTCTACGGTATGGACGTCTGGGGCCAAGGGACCACGGTCACCGTCTCCTCA<br>VH domain amino acid sequence: SEQ ID NO: 394<br>QVQLVQSGGEVKKPGASVKVSCKASGYTFTSYGFSWVRQAPGQGLEWMGWISAYNGNTNYAQKLQGRVTMTTDTSTS<br>TAYMELRSLRSDDTAVYYCARSTYFYGSGTLYGMDVWGQGTTVTVSS<br>VH CDR1 amino acid sequence: GYTFTSYG SEQ ID NO: 391<br>VH CDR2 amino acid sequence: ISAYNGNT SEQ ID NO: 392<br>VH CDR3 amino acid sequence: ARSTYFYGSGTLYGMDV SEQ ID NO: 393<br>VL domain nucleotide sequence: SEQ ID NO: 402<br>GATATTGTGATGACTCAGTCTCCACTCTCCCTGCCCGTCACCCCTGGAGAGCCGGCCTCCATCTCCTGCAGGTCTAG<br>TCAGAGCCTCCTGCATAGTGATGGATACAACTGTTTGGATTGGTACCTGCAGAAGCCAGGGCAGTCTCCACAGCTCC<br>TGATCTATTTGGGTTCTACTCGGGCCTCCGGGTTCCCTGACAGGTTCAGTGGCAGTGGATCAGGCACAGATTTTACA<br>CTGAAAATCAGCAGAGTGGAGGCTGAGGATGTTGGGGTTTATTACTGCATGCAAGCTCTACAAACTCCGTGCAGTTT<br>TGGCCAGGGGACCAAGCTGGAGATCAAA<br>VL domain amino acid sequence: SEQ ID NO: 401<br>DIVMTQSPLSLPVTPGEPASISCRSSQSLLHSDGYNCLDWYLQKPGQSPQLLIYLGSTRASGFPDRFSGSGSGTDFT<br>LKISRVEAEDVGVYYCMQALQTPCSFGQGTKLEIK<br>VL CDR1 amino acid sequence: QSLLHSDGYNC SEQ ID NO: 398<br>VL CDR2 amino acid sequence: IGS SEQ ID NO: 399<br>VL CDR3 amino acid sequence: MQALQTPCS SEQ ID NO: 400<br><br>Antibody STIM003<br>VH domain nucleotide sequence: SEQ ID NO: 409<br>GAGGTGCAGCTGGTGGAGTCTGGGGGAGGTGTGGTACGGCCTGGGGGGTCCCTGAGACTCTCCTGTGTAGCCTCTGG<br>AGTCACCTTTGATGATTATGGCATGAGCTGGGTCCGCCAAGCTCCAGGGAAGGGGCTGGARTGGGTCTCTGGTATTA<br>ATTGGAATGGTGGCGACACAGATTATTCAGACTCTGTGAAGGGCCGATTCACCATCTCCAGAGACAACGCCAAGAAC<br>TCCCTGTATCTACAAATGAATAGTCTGAGAGCCGAGGACACGGCCTTGTATTACTGTGCGAGGGATTTCTATGGTTC<br>GGGGAGTTATTATCACGTTCCTTTTGACTACTGGGGCCAGGGAATCCTGGTCACCGTCTCCTCA<br>Corrected STIM003 VH domain nucleotide sequence: SEQ ID NO: 521<br>GAGGTGCAGCTGGTGGAGTCTGGGGGAGGTGTGGTACGGCCTGGGGGGTCCCTGAGACTCTCCTGTGTAGCCTCTGG<br>AGTCACCTTTGATGATTATGGCATGAGCTGGGTCCGCCAAGCTCCAGGGAAGGGGCTGGAGTGGGTCTCTGGTATTA<br>ATTGGAATGGTGGCGACACAGATTATTCAGACTCTGTGAAGGGCCGATTCACCATCTCCAGAGACAACGCCAAGAAC<br>TCCCTGTATCTACAAATGAATAGTCTGAGAGCCGAGGACACGGCCTTGTATTACTGTGCGAGGGATTTCTATGGTTC<br>GGGGAGTTATTATCACGTTCCTTTTGACTACTGGGGCCAGGGAATCCTGGTCACCGTCTCCTCA<br>VH domain amino acid sequence: SEQ ID NO: 408<br>EVQLVESGGGVVRPGGSLRLSCVASGVTFDDYGMSWVRQAPGKGLEWVSGINWNGGDTDYSDSVKGRFTISRDNAKN<br>SLYLQMNSLRAEDTALYYCARDFYGSGSYYHVPFDYWGQGILVTVSS<br>VH CDR1 amino acid sequence: GVTFDDYG SEQ ID NO: 405<br>VH CDR2 amino acid sequence: INWNGGDT SEQ ID NO: 406<br>VH CDR3 amino acid sequence: ARDFYGSGSYYHVPFDY SEQ ID NO: 407<br>VL domain nucleotide sequence: SEQ ID NO: 416<br>GAAATTGTGTTGACGCAGTCTCCAGGGACCCTGTCTTTGTCTCCAGGGGAAAGAGCCACCCTCTCCTGCAGGGCCAG<br>TCAGAGTGTTAGCAGAAGCTACTTAGCCTGGTACCAGCAGAAACGTGGCCAGGCTCCCAGGCTCCTCATCTATGGTG<br>CATCCAGCAGGGCCACTGGCATCCCAGACAGGTTCAGTGGCGATGGGTCTGGGACAGACTTCACTCTCTCCATCAGC<br>AGACTGGAGCCTGAAGATTTTGCAGTGTATTACTGTCACCAGTATGATATGTCACCATTCACTTTCGGCCCTGGGAC<br>CAAAGTGGATATCAAA<br>VL domain amino acid sequence: SEQ ID NO: 415<br>EIVLTQSPGTLSLSPGERATLSCRASQSVSRSYLAWYQQKRGQAPRLLIYGASSRATGIPDRFSGDGSGTDFTLSIS<br>RLEPEDFAVYYCHQYDMSPFTFGPGTKVDIK<br>VL CDR1 amino acid sequence: QSVSRSY SEQ ID NO: 412<br>VL CDR2 amino acid sequence: GAS SEQ ID NO: 413<br>VL CDR3 amino acid sequence: HQYDMSPFT SEQ ID NO: 414<br><br>Antibody STIM004<br>VH domain nucleotide sequence:<br>GAGGTGCAGCTGGTGGAGTCTGGGGGAGGTGTGGTACGGCCTGGGGGGTCCCTGAGACTCTCCTGTGCAGCCTCTGG<br>ACTCACCTTTGATGATTATGGCATGAGCTGGGTCCGCCAAGTTCCAGGGAAGGGGCTGGAGTGGGTCTCTGGTATTA |

| Sequences |
|---|
| ATTGGAATGGTGATAACACAGATTATGCAGACTCTGTGAAGGGCCGATTCACCATCTCCAGAGACAACGCCAAGAAC
TCCCTGTATCTGCAAATGAACAGTCTGAGAGCCGAGGACACGGCCTTGTATTACTGTGCGAGGGATTACTATGGTTC
GGGGAGTTATTATAACGTTCCTTTTGACTACTGGGGCCAGGGAACCCTGGTCACCGTCTC-
CTCA SEQ ID NO: 423
VH domain amino acid sequence:
EVQLVESGGGVVRPGGSLRLSCAASGLTFDDYGMSWVRQVPGKGLEWVSGINWNGDNTDYADSVKGRFTISRDNAKN
SLYLQMNSLRAEDTALYYCARDYYGSGSYYNVPFDYWGQGTLVTVSS SEQ ID NO: 422
VH CDR1 amino acid sequence: GLTFDDYG SEQ ID NO: 419
VH CDR2 amino acid sequence: INWNGDNT SEQ ID NO: 420
VH CDR3 amino acid sequence: ARDYYGSGSYYNVPFDY SEQ ID NO: 421
VL domain nucleotide sequence: SEQ ID NO: 431
GAAATTGTGTTGACGCAGTCTCCAGGCACCCTGTCTTTGTCTCCAGGGGAAAGAGCCACCCTCTCCTGCAGGGCCAG
TCAGAGTGTTAGCAGCAGCTACTTAGCCTGGTACCAGCAGAAACCTGGCCAGGCTCCCAGGCTCCTCATATATGGTG
CATCCAGCAGGGCCACTGGCATCCCAGACAGGTTCAGTGGCAGTGGGTCTGGGACAGACTTCACTCTCACCATCAGA
AGACTGGAGCCTGAAGATTTTGCAGTGTATTACTGTCAGCAGTATGGTAGTTCACCATTCACTTCGGCCCTGGGACC
AAAGTGGATATCAAA
VL domain amino acid sequence as encoded by the above VL domain nucleotide
sequence.
Corrected VL domain nucleotide sequence: SEQ ID NO: 430
GAAATTGTGTTGACGCAGTCTCCAGGCACCCTGTCTTTGTCTCCAGGGGAAAGAGCCACCCTCTCCTGCAGGGCCAG
TCAGAGTGTTAGCAGCAGCTACTTAGCCTGGTACCAGCAGAAACCTGGCCAGGCTCCCAGGCTCCTCATATATGGTG
CATCCAGCAGGGCCACTGGCATCCCAGACAGGTTCAGTGGCAGTGGGTCTGGGACAGACTTCACTCTCACCATCAGA
AGACTGGAGCCTGAAGATTTTGCAGTGTATTACTGTCAGCAGTATGGTAGTTCACCATTCTTCGGCCCTGGGACCAA
AGTGGATATCAAA
Corrected VL domain amino acid sequence: SEQ ID NO: 432
EIVLTQSPGTLSLSPGERATLSCRASQSVSSSYLAWYQQKPGQAPRLLIYGASSRATGIPDRFSGSGSGTDFTLTIR
RLEPEDFAVYYCQQYGSSPFFGPGTKVDIK
VL CDR1 amino acid sequence: QSVSSSY SEQ ID NO: 426
VL CDR2 amino acid sequence: GAS SEQ ID NO: 427
VL CDR3 amino acid sequence: QQYGSSPF SEQ ID NO: 428

Antibody STIM005
VH domain nucleotide sequence: SEQ ID NO: 439
CAGGTTCAGTTGGTGCAGTCTGGAGCTGAGGTGAAGAAGCCTGGGGCCTCAGTGAAGGTCTCCTGCAAGGCTTCTGG
TTACACCTTTAATAGTTATGGTATCATCTGGGTGCGACAGGCCCCTGGACAAGGGCTTGAGTGGATGGGATGGATCA
GCGTTCACAATGGTAACACAAACTGTGCACAGAAGCTCCAGGGTAGAGTCACCATGACCACAGACACATCCACGAGC
ACAGCCTACATGGAGCTGAGGAGCCTGAGAACTGACGACACGGCCGTGTATTACTGTGCGAGAGCGGGTTACGATAT
TTTGACTGATTTTTCCGATGCTTTTGATATCTGGGGCCACGGGACAATGGTCACCGTCTCTTCA
VH domain amino acid sequence: SEQ ID NO: 438
QVQLVQSGAEVKKPGASVKVSCKASGYTFNSYGI IWVRQAPGQGLEWMGWI SVHNGNTNCAQKLQGRVT-
MTTDTSTS
TAYMELRSLRTDDTAVYYCARAGYDILTDFSDAFDIWGHGTMVTVSS
VH CDR1 amino acid sequence: GYTFNSYG SEQ ID NO: 435
VH CDR2 amino acid sequence: ISVHNGNT SEQ ID NO: 436
VH CDR3 amino acid sequence: ARAGYDILTDFSDAFDI SEQ ID NO: 437
VL domain nucleotide sequence: SEQ ID NO: 446
GACATCCAGATGACCCAGTCTCCATCCTCCCTGTCTGCATCTGTAGGAGACAGAGTCACCATCACTTGCCGGGCAAG
TCAGAACATTAATAACTT TTTAAATTGGTATCAGCAGAAAGAAGGGAAAGGCCCTAAGCTCCTGATCTATGCAGCAT
CCAGTTTGCAAAGAGGGGATACCATCAACGTTCAGTGGCAGTGGATCTGGGACAGACTTCACTCTCACCATCAGCAGT
CTGCAACCTGAAGATTTTGCAACTTACATCTGTCAACAGAGCTACGGTATCCCGTGGGTCGGCCAAGGGACCAAGGT
GGAAATCAAA
VL domain amino acid sequence: SEQ ID NO: 445
DIQMTQSPSSLSASVGDRVTITCRASQNINNFLNWYQQKEGKGPKLLIYAASSLQRGIPSTFSGSGSGTDFTLTISS
LQPEDFATYICQQSYGIPWVGQGTKVEIK
VL CDR1 amino acid sequence: QNINNF SEQ ID NO: 442
VL CDR2 amino acid sequence: AAS SEQ ID NO: 443
VL CDR3 amino acid sequence: QQSYGIPW SEQ ID NO: 444

Antibody STIM006
VH domain nucleotide sequence: SEQ ID NO: 453
CAGGTGCAGCTGGTGGAGTCTGGGGGAGGCTTGGTCAAGCCTGGAGGGTCCCTGAGACTCTCCTGTGCAGCCTCTGG
ATTCACCTTCAGTGACTACTTCATGAGCTGGATCCGCCAGGCGCCAGGGAAGGGGCTGGAGTGGATTTCATACATTA
GTTCTAGTGGTAGTACCATATACTACGCAGACTCTGTGAAGGGCCGATTCACCATCTCCAGGGACAACGCCAAGTAC
TCACTGTATCTGCAAATGAACAGCCTGAGATCCGAGGACACGGCCGTGTATTACTGTGCGAGAGATCACTACGATGG
TTCGGGGATTTATCCCCTCTACTACTATTACGGTTTGGACGTCTGGGGCCAGGGGACCACGGTCACCGTCTCCTCA
VH domain amino acid sequence: SEQ ID NO: 454
QVQLVESGGGLVKPGGSLRLSCAASGFTFSDYFMSWIRQAPGKGLEWISYISSSGSTIYYADSVRGRFTISRDNAKY
SLYLQMNSLRSEDTAVYYCARDHDGSGIYPLYYYYGLDVWGQGTTVTVSS
VH CDR1 amino acid sequence: GFTFSDYF SEQ ID NO: 449
VH CDR2 amino acid sequence: ISSSGSTI SEQ ID NO: 450
VH CDR3 amino acid sequence: ARDHYDGSGIYPLYYYYGLDV SEQ ID NO: 451
VL domain nucleotide sequence: SEQ ID NO: 460
ATTGTGATGACTCAGTCTCCACTCTCCCTACCCGTCACCCCTGGAGAGCCGGCCTCCATCCTCTGCAGGTCTAGTCA
GAGCCTCCTGCATAGTAATGGATACAACTATTTGGATTATTACCTGCAGAAGCCAGGGCAGTCTCCACAGCTCCTGA |

| Sequences |
|---|
| TCTATTTGGGTTCTTATCGGGCCTCCGGGGTCCCTGACAGGTTCAGTGGCAGTGGATCAGGCACAGATTTTACACTG
AAAATCAGCAGAGTGGAGGCTGAGGATGTTGGGGTTTATTACTGCATGCAAGCTCTACAAACTCCTCGCAGTTTTGG
CCAGGGGACCACGCTGGAGATCAAA
VL domain amino acid sequence: SEQ ID NO: 459
IVMTQSPLSLPVTPGEPASISCRSSQSLLHSNGYNYLDYYLQKPGQSPQLLIYLGSYRASGVPDRFSGSGSGTDFTL
KISRVEAEDVGVYYCMQALQTPRSFGQGTTLEIK
VL CDR1 amino acid sequence: QSLLHSNGYNY SEQ ID NO: 456
VL CDR2 amino acid sequence: IGS SEQ ID NO: 457
VL CDR3 amino acid sequence: MQALQTPRS SEQ ID NO: 458

Antibody STIM007
VH domain nucleotide sequence: SEQ ID NO: 467
CAGATCACCTTGAAGGAGTCTGGTCCTACGCTGGTGAAACCCACACAGACCCTCACGCTGACCTGCACCTTCTCTGG
GTTCTCACTCAGCACTACTGGAGTGGGTGTGGGCTGGATCCGTCAGCCCCCAGGAAAGGCCCTGGAGTGGCTTGCAG
TCATTTATTGGGATGATGATAAGCGCTACAGCCCATCTCTGAAGAGCAGACTCACCATCACCAAGGACACCTCCAAA
AACCAGGTGGTCCTTACAATGACCAACATGGACCCTGTGGACACAGCCACATATTTCTGTACACACGGATATGGTTC
GGCGAGTTATTACCACTACGGTATGGACGTCTGGGGCCAAGGGACCACGGTCACCGTCTCCTCA
VH domain amino acid sequence: SEQ ID NO: 466
QITLKESGPTLVKPTQTLTLTCTFSGFSLSTTGVGVGWIRQPPGKALEWLAVIYWDDDKRYSPSLKSRLTITKDTSK
NQVVLTMTNMDPVDTATYFCTHGYGSASYYHYGMDVWGQGTTVTVSS
VH CDR1 amino acid sequence: GFSLSTTGVG SEQ ID NO: 463
VH CDR2 amino acid sequence: IYWDDDK SEQ ID NO: 464
VH CDR3 amino acid sequence: THGYGSASYYHYGMDV SEQ ID NO: 465
VL domain nucleotide sequence: SEQ ID NO: 474
GAAATTGTATTGACACAGTCTCCAGCCACCCTGTCTTTGTCTCCAGGGGAAAGAGCCACCCTCTCCTGCAGGGCCAG
TCAGAGTGTTACCAACTACTTAGCCTGGCACCAACAGAAACCTGGCCAGGCTCCCAGGCTCCTCATCTATGATGCAT
CCAACAGGGCCACTGGCATCCCAGCCAGGTTCAGTGGCAGTGGGTCTGGGACAGACTTCACTCTCACCATCAGCAGC
CTAGAGCCTGAAGATTTTGCAGTTTATTACTGTCAGCACCGTAGCAACTGGCCTCTCACTTTCGGCGGAGGGACCAA
GGTGGAGATCAAAC
VL domain amino acid sequence: SEQ ID NO: 473
EIVLTQSPATLSLSPGERATLSCRASQSVTNYLAWHQQKPGQAPRLLIYDASNRATGIPARFSGSGSGTDFTLTISS
LEPEDFAVYYCQHRSNWPLTFGGGTKVEIK
VL CDR1 amino acid sequence: QSVTNY SEQ ID NO: 470
VL CDR2 amino acid sequence: DAS SEQ ID NO: 471
VL CDR3 amino acid sequence: QHRSNWPLT SEQ ID NO: 472

Antibody STIM008
VH domain nucleotide sequence: SEQ ID NO: 481
CAGATCACCTTGAAGGAGTCTGGTCCTACGCTGGTGAAACCCACACAGACCCTCACGCTGACCTGCACCTTCTCTGG
GTTCTCACTCAGCACTAGTGGAGTGGGTGTGGGCTGGATCCGTCAGCCCCCAGGAAAGGCCCTGGAGTGGCTTGCAG
TCATTTATTGGGATGATGATAAGCGCTACAGCCCATCTCTGAAGAGCAGGCTCACCATCACCAAGGACACCTCCAAA
AACCAGGTGGTCCTTACAATGACCAACATGGACCCTGTGGACACAGCCACATATTTCTGTACACACGGATATGGTTC
GGCGAGTTATTACCACTACGGTATGGACGTCTGGGGCCAAGGGACCACGGTCACCGTCTCCTCA
VH domain amino acid sequence: SEQ ID NO: 480
QITLKESGPTLVKPTQTLTLTCTFSGFSLSTSGVGVGWIRQPPGKALEWLAVIYWDDDKRYSPSLKSRLTITKDTSK
NQVVLTMTNMDPVDTATYFCTHGYGSASYYHYGMDVWGQGTTVTVSS
VH CDR1 amino acid sequence: GFSLSTSGVG SEQ ID NO: 477
VH CDR2 amino acid sequence: IYWDDDK SEQ ID NO: 478
VH CDR3 amino acid sequence: THGYGSASYYHYGMDV SEQ ID NO: 479
VL domain nucleotide sequence: SEQ ID NO: 488
GAAATTGTGTTGACACAGTCTCCAGCCACCCTGTCTTTGTCTCCAGGGGAAAGAGCCACCCTCTCCTGCAGGGCCAG
TCAGAGTGTTACCAACTACTTAGCCTGGCACCAACAGAAACCTGGCCAGGCTCCCAGGCTCCTCATCTATGATGCAT
CCAACAGGGCCACTGGCATCCCAGCCAGGTTCAGTGGCAGTGGGTCTGGGACAGACTTCACTCTCACCATCAGCAGC
CTAGAGCCTGAAGATTTTGCAGTTTATTACTGTCAGCAGCGTAGCAACTGGCCTCTCACTTTCGGCGGAGGGACCAA
GGTGGAGATCAAA
VL domain amino acid sequence: SEQ ID NO: 489
EIVLTQSPATLSLSPGERATLSCRASQSVTNYLAWHQQKPGQAPRLLIYDASNRATGIPARFSGSGSGTDFTLTISS
LEPEDFAVYYCQQRSNWPLTFGGGTKVEIK
VL CDR1 amino acid sequence: QSVTNY SEQ ID NO: 484
VL CDR2 amino acid sequence: DAS SEQ ID NO: 485
VL CDR3 amino acid sequence: QQRSNWPLT SEQ ID NO: 486

Antibody STIM009
VH domain nucleotide sequence: SEQ ID NO: 495
CAGGTGCAGCTGGTGGAGTCTGGGGGAGGCTTGGTCAAGCCTGGAGGGTCCCTGAGACTCTCCTGTGCAGCCTCTGG
ATTCACCTTCAGTGACTACTACATGAGCTGGATCCGCCAGGCTCCAGGGAAGGGGCTGGAGTGGGTTTCATACATTA
GTAGTAGTGGTAGTACCATATACTACGCAGACTCTGTGAAGGGCCGATTCACCATCTCCAGGGACAACGCCAAGAAC
TCACTGTATCTGCAAATTAACAGCCTGAGAGCTGAGGACACGGCTGTATTACTGTGCGAGAGATTTTTACGATAT
TTTGACTGATAGTCCGTACTTCTACTACGGTGTGGACGTCTGGGGCCAAGGGACCACGGTCACCGTCTCCTCA
VH domain amino acid sequence: SEQ ID NO: 494
QVQLVESGGGLVKPGGSLRLSCAASGFTFSDYYMSWIRQAPGKGLEWVSYISSSGSTIYYADSVKGRFTISRDNAKN
SLYLQINSLRAEDTAVYYCARDFYDILTDSPYFYYGVDVWGQGTTVTVSS
VH CDR1 amino acid sequence: GFTFSDYY SEQ ID NO: 491
VH CDR2 amino acid sequence: ISSSGSTI SEQ ID NO: 492 |

-continued

| Sequences |
|---|
| VH CDR3 amino acid sequence: ARDFYDILTDSPYFYYGVDV SEQ ID NO: 493<br>VL domain nucleotide sequence: SEQ ID NO: 502<br>GATATTGTGATGACTCAGTCTCCACTCTCCCTGCCCGTCACCCCTGGAGAGCCGGCCTCCATCTCCTGCAGGTCTAG<br>TCAGAGCCTCCTGCATAGTAATGGATACAACTATTTGGATTGGTACCTGCAGAAGCCAGGGCAGTCTCCACAGCTCC<br>TGATCTATTTGGGTTCTAATCGGGCCTCCGGGGTCCCTGACAGGTTCAGTGGCAGTGGATCAGGCACAGATTTTACA<br>CTGAAAATCAGCAGAGTGGAGGCTGAGGATGTTGGGGTTTATTACTGCATGCAAGCTCTACAAACTCCTCGGACGTT<br>CGGCCAAGGGACCAAGGTGGAAATCAAA<br>VL domain amino acid sequence: SEQ ID NO: 501<br>DIVMTQSPLSLPVTPGEPASISCRSSQSLLHSNGYNYLDWYLQKPGQSPQLLIYLGSNRASGVPDRFSGSGSGTDFT<br>LKISRVEAEDVGVYYCMQALQTPRTFGQGTKVEIK<br>VL CDR1 amino acid sequence: QSLLHSNGYNY SEQ ID NO: 498<br>VL CDR2 amino acid sequence: IGS SEQ ID NO: 499<br>VL CDR3 amino acid sequence: MQALQTPRT SEQ ID NO: 500 |

TABLE S1

SEQ ID NOS: 1-342

| SEQ ID NO: | Name | Description | Sequence |
|---|---|---|---|
| 1 | Human PD-L1 | NCBI number: NP_054862.1 (ECD highlighted in BOLD, cytoplasmic domain underlined) | MRIFAVFIFMTYWHLLNAFTVTVPKDLYVVEYGSNMTIECKFPVEKQLD LAALIVYWEMEDKNIIQFVHGEEDLKVQHSSYRQRARLLKDQLSLGNAA LQITDVKLQDAGVYRCMISYGGADYKRITVKVNAPYNKINQRILVVDPV TSEHELTCQAEGYPKAEVIWTSSDHQVLSGKTTTTNSKREEKLFNVTST LRINTTTNEIFYCTFRRLDPEENHTAELVIPELPLAHPPNERTHLVILG AILLCLGVALTFIFRLRKGRAMDVKKCGIQDTNSKKQSDTHLEET |
| 2 | Cyno PD-L1 | NCBI number: XP_014973154.1 (ECD highlighted in BOLD) | MGWSCIILFLVATATGVHSMFTVTVPKDLYVVEYGSNMTIECKFPVEKQ LDLTSLIVYWEMEDKNIIQFVHGEEDLKVQHSNYRQRAQLLKDQLSLGN AALRITDVKLQDAGVYRCMISYGGADYKRITVKVNAPYNKINQRILVVD PVTSEHELTCQAEGYPEAEVIWTSSDHQVLSGKTTTTNSKREEKLLNVT STLRINTTANEIFYCIFRRLDPEENHTAELVIPELPLALPPNERT |
| 3 | Human PD-L1 His | Human PD-L1 ECD with C-terminal His tag | MRIFAVFIFMTYWHLLNAFTVTVPKDLYVVEYGSNMTIECKFPVEKQLD LAALIVYWEMEDKNIIQFVHGEEDLKVQHSSYRQRARLLKDQLSLGNAA LQITDVKLQDAGVYRCMISYGGADYKRITVKVNAPYNKINQRILVVDPV TSEHELTCQAEGYPKAEVIWTSSDHQVLSGKTTTTNSKREEKLFNVTST LRINTTTNEIFYCTFRRLDPEENHTAELVIPELPLAHPPNERTHHHHHH |
| 4 | Human PD-L1 Fc | Human PD-L1 ECD with C-term Fc fusion (in bold) | MRIFAVFIFMTYWHLLNAFTVTVPKDLYVVEYGSNMTIECKFPVEKQLD LAALIVYWEMEDKNIIQFVHGEEDLKVQHSSYRQRARLLKDQLSLGNAA LQITDVKLQDAGVYRCMISYGGADYKRITVKVNAPYNKINQRILVVDPV TSEHELTCQAEGYPKAEVIWTSSDHQVLSGKTTTTNSKREEKLFNVTST LRINTTTNEIFYCTFRRLDPEENHTAELVIPELPLAHPPNERTIEGREP KSCDKTHTCPPCPAPELLGGPSVFLFPPKPKDTLMISRTPEVTCVVVDV SHEDPEVKFNWYVDGVEVHNAKTKPREEQYNSTYRVVSVLTVLHQDWLN GKEYKCKVSNKALPAPIEKTISKAKGQPREPQVYTLPPSRDELTKNQVS LTCLVKGFYPSDIAVEWESNGQPENNYKTTPPVLDSDGSFFLYSKLTVD KSRWQQGNVFSCSVMHEALHNHYTQKSLSLSPGK |
| 5 | Cyno PD-L1 FLAG | Cynomolgus PD-L1 ECD with N-term FLAG tag | MGWSCIILFLVATATGVHSMFTVTVPKDLYVVEYGSNMTIECKFPVEKQ LDLTSLIVYWEMEDKNIIQFVHGEEDLKVQHSNYRQRAQLLKDQLSLGN AALRITDVKLQDAGVYRCMISYGGADYKRITVKVNAPYNKINQRILVVD PVTSEHELTCQAEGYPKAEVIWTSSDHQVLSGKTTTTNSKREEKLLNVT STLRINTTANEIFYCIFRRLDPEENHTAELVIPELPLALPPNERTDYKD DDDK |
| 6 | Human PD-1 Fc | Human PD-1 full length sequence derived from cDNA as human Fc fusion | MGWSCIILFLVATATGVHSLDSPDRPWNPPTFSPALLVVTEGDNATFTC SFSNTSESFVLNWYRMSPSNQTDKLAAFPEDRSQPGQDCRFRVTQLPNG RDFHMSVVRARRNDSGTYLCGAISLAPKAQIKESLRAELRVTERRAEVP TAHPSPSPRPAGQKLENLYFQGIEGRMDEPKSCDKTHTCPPCPAPELLG GPSVFLFPPKPKDTLMISRTPEVTCVVVDVSHEDPEVKFNWYVDGVEVH NAKTKPREEQYNSTYRVVSVLTVLHQDWLNGKEYKCKVSNKALPAPIEK TISKAKGQPREPQVYTLPPSRDELTKNQVSLTCLVKGFYPSDIAVEWES NGQPENNYKTTPPVLDSDGSFFLYSKLTVDKSRWQQGNVFSCSVMHEAL HNHYTQKSLSLSP |
| 7 | 84G09-CDRH1 (IMGT) | Amino acid sequence of CDRH1 of 84G09 using IMGT | GFTFDDYA |

TABLE S1 -continued

SEQ ID NOS: 1-342

| SEQ ID NO: | Name | Description | Sequence |
|---|---|---|---|
| 8 | 84G09-CDRH2 (IMGT) | Amino acid sequence of CDRH2 of 84G09 using IMGT | ISWKSNII |
| 9 | 84G09-CDRH3 (IMGT) | Amino acid sequence of CDRH3 of 84G09 using IMGT | ARDITGSGSYGWFDP |
| 10 | 84G09-CDRH1 (Kabat) | Amino acid sequence of CDRH1 of 84G09 using Kabat | DYAMH |
| 11 | 84G09-CDRH2 (Kabat) | Amino acid sequence of CDRH2 of 84G09 using Kabat | GISWKSNIIGYADSVKG |
| 12 | 84G09-CDRH3 (Kabat) | Amino acid sequence of CDRH3 of 84G09 using Kabat | DITGSGSYGWFDP |
| 13 | 84G09-Heavy chain variable region | Amino acid sequence of V$_H$ of 84G09 (mutations from germline are shown in bold letters) | EVQLVESGGGLVQPGRSLRLSCAASGFTFDDYAMHWVRQTPGKGLEWVS GISWKSNIIGYADSVKGRFTISRDNAKNSLYLQMNSLRAEDTALYYCAR DITGSGSYGWFDPWGQGTLVTVSS |
| 14 | 84G09-Heavy chain variable region | Nucleic acid sequence of V$_H$ of 84G09 | CAaGAAAAAGCTTGCCGCCACCATGGAGTTTGGGCTGAGCTGGATTTTC CTTTTGGCTATTTTAAAAGGTGTCCAGTGTGAAGTACAATTGGTGGAGT CCGGGGGAGGCTTGGTACAGCCTGGCAGGTCCCTGAGACTCTCCTGTGC AGCCTCTGGATTCACCTTTGATGATTATGCCATGCACTGGGTCCGACAA ACTCCAGGGAAGGGCCTGGAGTGGGTCTCAGGTATAAGTTGGAAGAGTA ATATCATAGGCTATGCGGACTCTGTGAAGGGCCGATTCACCATCTCCAG AGACAACGCCAAGAACTCCCTGTATCTGCAAATGAACAGTCTGAGAGCT GAGGACACGGCCTTGTATTATTGTGCAAGAGATATAACGGGTTCGGGGA GTTATGGCTGGTTCGACCCCTGGGGCCAGGGAACCCTGGTCACCGTCTC CTCAGCCAAAACGACACCCCCATCTGTCTATCCACTGGCCCCTGAATCT GCTAAAACTCAGCCTCCG |
| 15 | 84G09-full heavy chain sequence | Amino acid sequence of 84G09 heavy chain (mutations from germline are shown in bold letters) | EVQLVESGGGLVQPGRSLRLSCAASGFTFDDYAMHWVRQTPGKGLEWVS GISWKSNIIGYADSVKGRFTISRDNAKNSLYLQMNSLRAEDTALYYCAR DITGSGSYGWFDPWGQGTLVTVSSASTKGPSVFPLAPCSRSTSESTAAL GCLVKDYFPEPVTVSWNSGALTSGVHTFPAVLQSSGLYSLSSVVTVPSS SLGTKTYTCNVDHKPSNTKVDKRVESKYGPPCPPCPAPEFEGGPSVFLF PPKPKDTLMISRTPEVTCVVVDVSQEDPEVQFNWYVDGVEVHNAKTKPR EEQFNSTYRVVSVLTVLHQDWLNGKEYKCKVSNKGLPSSIEKTISKAKG QPREPQVYTLPPSQEEMTKNQVSLTCLVKGFYPSDIAVEWESNGQPENN YKTTPPVLDSDGSFFLYSRLTVDKSRWQEGNVFSCSVMHEALHNHYTQK SLSLSLGK |
| 16 | 84G09-full heavy chain sequence | Nucleic acid sequence of 84G09 heavy chain | GAAGTGCAGCTGGTGGAATCTGGCGGCGGACTGGTGCAGCCTGGCAGAT CCCTGAGACTGTCTTGTGCCGCCTCCGGCTTCACCTTCGACGACTACGC TATGCACTGGGTGCGACAGACCCCTGGCAAGGGCCTGGAATGGGTGTCC GGCATCTCCTGGAAGTCCAACATCATCGGCTACGCCGACTCCGTGAAGG GCCGGTTCACCATCTCCCGGGACAACGCCAAGAACTCCCTGTACCTGCA GATGAACAGCCTGCGGGCCGAGGACACCGCCCTGTACTACTGCGCCAGA GACATCACCGGCTCCGGCTCCTACGGATGGTTCGATCCTTGGGGCCAGG GCACCCTCGTGACCGTGTCCTCTGCCAGCACCAAGGGCCCCTCTGTGTT CCCTCTGGCCCCTTGCAGCAGGTCCACCTCTGGCGGAACAGCCGCTCTG GGCTGCCTCGTGAAGGACTACTTCCCCGAGCCTGTGACCGTGTCCTGGA ACTCTGGCGCTCTGACCAGCGGAGTGCACACCTTCCCTGCTGTGCTGCA GTCCTCCGGCCTGTACTCCCTGTCCTCCGTCGTGACCGTGCCTTCCAGC TCTCTGGGCACCCAGACCTACATCTGCAACGTGAACCACAAGCCCTCCA ACACCAAGGTGGACAAGAAGGTGGAACCCAAGTCCTGCGACAAGACCCA CACCTGTCCCCCTTGTCCTGCCCCTGAACTGCTGGGCGGACCTTCCGTG TTCCTGTTCCCCCCAAAGCCCAAGGACACCCTGATGATCTCCCGGACCC CCGAAGTGACCTGCGTGGTGGTGGATGTGTCCCACGAGGACCCTGAAGT GAAGTTCAATTGGTACGTGGACGGCGTGGAAGTGCACAACGCCAAGACC AAGCCTAGAGAGGAACAGTACAACTCCACCTACCGGGTGGTGTCCGTGC TGACCGTGCTGCACCAGGATTGGCTGAACGGCAAAGAGTACAAGTGCAA GGTGTCCAACAAGGGCCTGCCTGCCCCCATCGAAAAGACCATCTCCAAG GCCAAGGGCCAGCCCCGGGAACCCCAGGTGTACACACTGCCCCCTAGCA GGGACGAGCTGACCAAGAACCAGGTGTCCCTGACCTGTCTCGTGAAAGG CTTCTACCCCTCCGATATCGCCGTGGAATGGGAGTCCAACGGCCAGCCT GAGAACAACTACAAGACCACCCCCCCTGTGCTGGACTCCGACGGCTCAT |

TABLE S1 -continued

SEQ ID NOS: 1-342

| SEQ ID NO: | Name | Description | Sequence |
|---|---|---|---|
| | | | TCTTCCTGTACAGCAAGCTGACAGTGGACAAGTCCCGGTGGCAGCAGGG<br>CAACGTGTTCTCCTGCTCCGTGATGCACGAGGCCCTGCACAACCACTAC<br>ACCCAGAAGTCCCTGTCCCTGAGCCCCGGCAAG |
| 17 | 84G09-CDRL1 (IMGT) | Amino acid sequence of CDRL1 of 84G09 using IMGT | QSISSY |
| 18 | 84G09-CDRL2 (IMGT) | Amino acid sequence of CDRL2 of 84G09 using IMGT | VAS |
| 19 | 84G09-CDRL3 (IMGT) | Amino acid sequence of CDRL3 of 84G09 using IMGT | QQSYSNPIT |
| 20 | 84G09-CDRL1 (Kabat) | Amino acid sequence of CDRL1 of 84G09 using Kabat | RASQSISSYLN |
| 21 | 84G09-CDRL2 (Kabat) | Amino acid sequence of CDRL2 of 84G09 using Kabat | VASSLQS |
| 22 | 84G09-CDRL3 (Kabat) | Amino acid sequence of CDRL3 of 84G09 using Kabat | QQSYSNPIT |
| 23 | 84G09-Light chain variable region | Amino acid sequence of VL of 84G09 | DIQMTQSPSSLSASVGDRVTITCRASQSISSYLNWYQQKPGKAPKPLIY<br>VASSLQSGVPSSFSGSGSGTDFTLTISSLQPEDFATYYCQQSYSNPITF<br>GQGTRLEIK |
| 24 | 84G09-Light chain variable region | Nucleic acid sequence of VL of 84G09 | GACATCCAGATGACCCAGTCTCCATCCTCCCTGTCTGCATCTGTAGGAG<br>ACAGAGTCACCATCACTTGCCGGGCAAGTCAGAGCATTAGCAGCTATTT<br>AAATTGGTATCAGCAGAAACCAGGGAAAGCCCCTAAGCCCCTGATCTAT<br>GTTGCATCCAGTTTGCAAAGTGGGGTCCCATCAAGTTTCAGTGGCAGTG<br>GATCTGGGACAGATTTCACTCTCACCATCAGCAGTCTGCAACCTGAAGA<br>TTTTGCAACTTACTACTGTCAACAGAGTTACAGTAATCCGATCACCTTC<br>GGCCAAGGGACACGACTGGAGATCAAA |
| 25 | 84G09-full light chain sequence | Amino acid sequence of 84G09 light chain | DIQMTQSPSSLSASVGDRVTITCRASQSISSYLNWYQQKPGKAPKPLIY<br>VASSLQSGVPSSFSGSGSGTDFTLTISSLQPEDFATYYCQQSYSNPITF<br>GQGTRLEIKRTVAAPSVFIFPPSDEQLKSGTASVVCLLNNFYPREAKVQ<br>WKVDNALQSGNSQESVTEQDSKDSTYSLSSTLTLSKADYEKHKVYACEV<br>THQGLSSPVTKSFNRGEC |
| 26 | 84G09-full light chain sequence | Nucleic acid sequence of 84G09 light chain | GACATCCAGATGACCCAGTCTCCATCCTCCCTGTCTGCATCTGTAGGAG<br>ACAGAGTCACCATCACTTGCCGGGCAAGTCAGAGCATTAGCAGCTATTT<br>AAATTGGTATCAGCAGAAACCAGGGAAAGCCCCTAAGCCCCTGATCTAT<br>GTTGCATCCAGTTTGCAAAGTGGGGTCCCATCAAGTTTCAGTGGCAGTG<br>GATCTGGGACAGATTTCACTCTCACCATCAGCAGTCTGCAACCTGAAGA<br>TTTTGCAACTTACTACTGTCAACAGAGTTACAGTAATCCGATCACCTTC<br>GGCCAAGGGACACGACTGGAGATCAAACGTACGGTGGCCGCTCCCTCCG<br>TGTTCATCTTCCCACCTTCCGACGAGCAGCTGAAGTCCGGCACCGCTTC<br>TGTCGTGTGCCTGCTGAACAACTTCTACCCCCGCGAGGCCAAGGTGCAG<br>TGGAAGGTGGACAACGCCCTGCAGTCCGGCAACTCCCAGGAATCCGTGA<br>CCGAGCAGGACTCCAAGGACAGCACCTACTCCCTGTCCTCCACCCTGAC<br>CCTGTCCAAGGCCGACTACGAGAAGCACAAGGTGTACGCCTGCGAAGTG<br>ACCCACCAGGGCCTGTCTAGCCCCGTGACCAAGTCTTTCAACCGGGGCG<br>AGTGT |
| 27 | 1D05-CDRH1 (IMGT) | Amino acid sequence of CDRH1 of 1D05 using IMGT | GFTFDDYA |
| 28 | 1D05-CDRH2 (IMGT) | Amino acid sequence of CDRH2 of 1D05 using IMGT | ISWIRTGI |
| 29 | 1D05-CDRH3 (IMGT) | Amino acid sequence of CDRH3 of 1D05 using IMGT | AKDMKGSGTYGGWFDT |

TABLE S1 -continued

SEQ ID NOS: 1-342

| SEQ ID NO: | Name | Description | Sequence |
|---|---|---|---|
| 30 | 1D05-CDRH1 (Kabat) | Amino acid sequence of CDRH1 of 1D05 using Kabat | DYAMH |
| 31 | 1D05-CDRH2 (Kabat) | Amino acid sequence of CDRH2 of 1D05 using Kabat | GISWIRTGIGYADSVKG |
| 32 | 1D05-CDRH3 (Kabat) | Amino acid sequence of CDRH3 of 1D05 using Kabat | DMKGSGTYGGWFDT |
| 33 | 1D05-Heavy chain variable region | Amino acid sequence of VH of 1D05 (mutations from germline are shown in bold letters) | EVQLVESGGGLVQPGRSLRLSCAASGFTFDDYAMHWVRQVPGKGLEWVS GISWIRTGIGYADSVKGRFTIFRDNAKNSLYLQMNSLRAEDTALYYCAK DMKGSGTYGGWFDTWGQGTLVTVSS |
| 34 | 1D05-Heavy chain variable region | Nucleic acid sequence of $V_H$ of 1D05 | AAGCTTGCCGCCACCATGGAGTTTGGGCTGAGCTGGATTTTCCTTTTGG CTATTTTAAAAGGTGTCCAGTGTGAAGTGCAGCTGGTGGAGTCTGGGGG AGGCTTGGTGCAGCCTGGCAGGTCCCTGAGACTCTCCTGTGCAGCCTCT GGATTCACCTTTGATGATTATGCCATGCACTGGGTCCGGCAAGTTCCAG GGAAGGGCCTGGAATGGGTCTCAGGCATTAGTTGGATTCGTACTGGCAT AGGCTATGCGGACTCTGTGAAGGGCCGATTCACCATTTTCAGAGACAAC GCCAAGAATTCCCTGTATCTGCAAATGAACAGTCTGAGAGCTGAGGACA CGGCCTTGTATTACTGTGCAAAAGATATGAAGGGTTCGGGGACTTATGG GGGGTGGTTCGACACCTGGGGCCAGGGAACCCTGGTCACCGTCTCCTCA GCCAAAACAACAGCCCCATCGGTCTATCCACTGGCCCCTGC |
| 35 | 1D05-full heavy chain sequence | Amino acid sequence of 1D05 heavy chain | EVQLVESGGGLVQPGRSLRLSCAASGFTFDDYAMHWVRQVPGKGLEWVS GISWIRTGIGYADSVKGRFTIFRDNAKNSLYLQMNSLRAEDTALYYCAK DMKGSGTYGGWFDTWGQGTLVTVSSASTKGPSVFPLAPCSRSTSESTAA LGCLVKDYFPEPVTVSWNSGALTSGVHTFPAVLQSSGLYSLSSVVTVPS SSLGTKTYTCNVDHKPSNTKVDKRVESKYGPPCPPCPAPEFEGGPSVFL FPPKPKDTLMISRTPEVTCVVVDVSQEDPEVQFNWYVDGVEVHNAKTKP REEQFNSTYRVVSVLTVLHQDWLNGKEYKCKVSNKGLPSSIEKTISKAK GQPREPQVYTLPPSQEEMTKNQVSLTCLVKGFYPSDIAVEWESNGQPEN NYKTTPPVLDSDGSFFLYSRLTVDKSRWQEGNVFSCSVMHEALHNHYTQ KSLSLSLGK |
| 36 | 1D05-full heavy chain sequence | Nucleic acid sequence of 1D05 heavy chain | GAAGTGCAGCTGGTGGAATCTGGCGGCGGACTGGTGCAGCCTGGCAGAT CCCTGAGACTGTCTTGTGCCGCCTCCGGCTTCACCTTCGACGACTACGC TATGCACTGGGTGCGACAGGTGCCAGGCAAGGGCCTGGAATGGGTGTCC GGCATCTCTTGGATCCGGACCGGCATCGGCTACGCCGACTCTGTGAAGG GCCGGTTCACCATCTTCCGGGACAACGCCAAGAACTCCCTGTACCTGCA GATGAACAGCCTGCGGGCCGAGGACACCGCCCTGTACTACTGCGCCAAG GACATGAAGGGCTCCGGCACCTACGGCGGATGGTTCGATACTTGGGGCC AGGGCACCCTCGTGACCGTGTCCTCTGCCAGCACCAAGGGCCCCTCTGT GTTCCCTCTGGCCCCTTCCAGCAAGTCCACCTCTGGCGGAACAGCCGCT CTGGGCTGCCTCGTGAAGGACTACTTCCCCGAGCCTGTGACCGTGTCCT GGAACTCTGGCGCTCTGACCAGCGGAGTGCACACCTTCCCTGCTGTGCT GCAGTCCTCCGGCCTGTACTCCCTGTCCTCCGTCGTGACCGTGCCTTCC AGCTCTCTGGGCACCCAGACCTACATCTGCAACGTGAACCACAAGCCCT CCAACACCAAGGTGGACAAGAAGGTGGAACCCAAGTCCTGCGACAAGAC CCACACCTGTCCCCCTTGTCCTGCCCCTGAACTGCTGGGCGGACCTTCC GTGTTCCTGTTCCCCCCAAAGCCCAAGGACACCCTGATGATCTCCCGGA CCCCCGAAGTGACCTGCGTGGTGGTGGATGTGTCCCACGAGGACCCTGA AGTGAAGTTCAATTGGTACGTGGACGGCGTGGAAGTGCACAACGCCAAG ACCAAGCCTAGAGAGGAACAGTACAACTCCACCTACCGGGTGGTGTCCG TGCTGACCGTGCTGCACCAGGATTGGCTGAACGGCAAAGAGTACAAGTG CAAGGTGTCCAACAAGGCCCTGCCTGCCCCCATCGAAAAGACCATCTCC AAGGCCAAGGGCCAGCCCCGGGAACCCCAGGTGTACACACTGCCCCCTA GCAGGGACGAGCTGACCAAGAACCAGGTGTCCCTGACCTGTCTCGTGAA AGGCTTCTACCCCTCCGATATCGCCGTGGAATGGGAGTCCAACGGCCAG CCTGAGAACAACTACAAGACCACCCCCCCTGTGCTGGACTCCGACGGCT CATTCTTCCTGTACAGCAAGCTGACAGTGGACAAGTCCCGGTGGCAGCA GGGCAACGTGTTCTCCTGCTCCGTGATGCACGAGGCCCTGCACAACCAC TACACCCAGAAGTCCCTGTCCCTGAGCCCCGGCAAG |
| 37 | 1D05-CDRL1 (IMGT) | Amino acid sequence of CDRL1 of 1D05 using IMGT | QSISSY |

TABLE S1 -continued

SEQ ID NOS: 1-342

| SEQ ID NO: | Name | Description | Sequence |
|---|---|---|---|
| 38 | 1D05-CDRL2 (IMGT) | Amino acid sequence of CDRL2 of 1D05 using IMGT | VAS |
| 39 | 1D05-CDRL3 (IMGT) | Amino acid sequence of CDRL3 of 1D05 using IMGT | QQSYSTPIT |
| 40 | 1D05-CDRL1 (Kabat) | Amino acid sequence of CDRL1 of 1D05 using Kabat | RASQSISSYLN |
| 41 | 1D05-CDRL2 (Kabat) | Amino acid sequence of CDRL2 of 1D05 using Kabat | VASSLQS |
| 42 | 1D05-CDRL3 (Kabat) | Amino acid sequence of CDRL3 of 1D05 using Kabat | QQSYSTPIT |
| 43 | 1D05-Light chain variable region | Amino acid sequence of VL of 1D05 (mutations from germline are shown in bold letters) | DIQMTQSPSSLSASVGDRVTITCRASQSISSYLNWYQQKPGKAPKLLIYVASSLQSGVPSRFSGSGSGTDFTLTISSLQPEDFATYYCQQSYSTPITFGQGTRLEIK |
| 44 | 1D05-Light chain variable region | Nucleic acid sequence of VL of 1D05 | AAAGCTTGCCGCCACCATGAGGCTCCCTGCTCAGCTTCTGGGGCTCCTGCTACTCTGGCTCCGAGGTGCCAGATGTGACATCCAGATGACCCAGTCTCCATCCTCCCTGTCTGCATCTGTAGGAGACAGAGTCACCATCACTTGCCGGGCAAGTCAGAGCATTAGCAGCTATTTAAATTGGTATCAGCAGAAACCAGGGAAAGCCCCTAAACTCCTGATCTATGTTGCATCCAGTTTGCAAAGTGGGGTCCCATCAAGGTTCAGTGGCAGTGGATCTGGGACAGATTTCACTCTCACTATCAGCAGTCTGCAACCTGAAGATTTTGCAACTTACTACTGTCAACAGAGTTACAGTACCCCGATCACCTTCGGCCAAGGGACACGTCTGGAGATCAAACGTACGGATGCTGCACCAACT |
| 45 | 1D05-full light chain sequence | Amino acid sequence of 1D05 light chain | DIQMTQSPSSLSASVGDRVTITCRASQSISSYLNWYQQKPGKAPKLLIYVASSLQSGVPSRFSGSGSGTDFTLTISSLQPEDFATYYCQQSYSTPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC |
| 46 | 1D05-full light chain sequence | Nucleic acid sequence of 1D05 light chain | GACATCCAGATGACCCAGTCCCCCTCCAGCCTGTCTGCTTCCGTGGGCGACAGAGTGACCATCACCTGTCGGGCCTCCCAGTCCATCTCCTCCTACCTGAACTGGTATCAGCAGAAGCCCGGCAAGGCCCCCAAGCTGCTGATCTACGTGGCCAGCTCTCTGCAGTCCGGCGTGCCCTCTAGATTCTCCGGCTCTGGCTCTGGCACCGACTTTACCCTGACCATCAGCTCCCTGCAGCCCGAGGACTTCGCCACCTACTACTGCCAGCAGTCCTACTCCACCCCTATCACCTTCGGCCAGGGCACCCGGCTGGAAATCAAACGTACGGTGGCCGCTCCCTCCGTGTTCATCTTCCCACCTTCCGACGAGCAGCTGAAGTCCGGCACCGCTTCTGTCGTGTGCCTGCTGAACAACTTCTACCCCCGCGAGGCCAAGGTGCAGTGGAAGGTGGACAACGCCCTGCAGTCCGGCAACTCCCAGGAATCCGTGACCGAGCAGGACTCCAAGGACAGCACCTACTCCCTGTCCTCCACCCTGACCCTGTCCAAGGCCGACTACGAGAAGCACAAGGTGTACGCCTGCGAAGTGACCCACCAGGGCCTGTCTAGCCCCGTGACCAAGTCTTTCAACCGGGGCGAGTGT |
| 47 | Mutated 1D05-HC mutant 1 | Amino acid sequence of 1D05 heavy chain with V to A back-mutation in framework region to germline highlighted with IgG1 disabled (LAGA) constant region | EVQLVESGGGLVQPGRSLRLSCAASGFTFDDYAMHWVRQAPGKGLEWVSGISWIRTGIGYADSVKGRFTIFRDNAKNSLYLQMNSLRAEDTALYYCAKDMKGSGTYGGWFDTWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPELAGAPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK |
| 48 | Mutated 1D05-HC mutant 2 | Amino acid sequence of 1D05 heavy chain with F to S back-mutation in framework region to germline highlighted | EVQLVESGGGLVQPGRSLRLSCAASGFTFDDYAMHWVRQVPGKGLEWVSGISWIRTGIGYADSVKGRFTISRDNAKNSLYLQMNSLRAEDTALYYCAKDMKGSGTYGGWFDTWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPELAGAPSVFLFPPKPKDTLMISRTPEVTCVVVDVSQEDPEVQFNWYVDGVEVHNAKTKP |

TABLE S1 -continued

SEQ ID NOS: 1-342

| SEQ ID NO: | Name | Description | Sequence |
|---|---|---|---|
| | | with IgG1 disabled (LAGA) constant region | REEQFNSTYRVVSVLTVLHQDWLNGKEYKCKVSNKGLPSSIEKTISKAK GQPREPQVYTLPPSQEEMTKNQVSLTCLVKGFYPSDIAVEWESNGQPEN NYKTTPPVLDSDGSFFLYSRLTVDKSRWQEGNVFSCSVMHEALHNHYTQ KSLSLSLGK |
| 49 | Mutated 1D05-HC mutant 3 | Amino acid sequence of 1D05 heavy chain with ELLG to -PVA back-mutation in constant region to germline highlighted | EVQLVESGGGLVQPGRSLRLSCAASGFTFDDYAMHWVRQVPGKGLEWVS GISWIRTGIGYADSVKGRFTIFRDNAKNSLYLQMNSLRAEDTALYYCAK DMKGSGTYGGWFDTWGQGTLVTVSSASTKGPSVFPLAPCSRSTSESTAA LGCLVKDYFPEPVTVSWNSGALTSGVHTFPAVLQSSGLYSLSSVVTVPS SSLGTKTYTCNVDHKPSNTKVDKRVESKYGPPCPPCPAP-PVAGPSVFLFPPKPKDTLMISRTPEVTCVVVDVSQEDPEVQFNWYVDGV EVHNAKTKPREEQFNSTYRVVSVLTVLHQDWLNGKEYKCKVSNKGLPSS IEKTISKAKGQPREPQVYTLPPSQEEMTKNQVSLTCLVKGFYPSDIAVE WESNGQPENNYKTTPPVLDSDGSFFLYSRLTVDKSRWQEGNVFSCSVMH EALHNHYTQKSLSLSLGK |
| 50 | Mutated 1D05-LC mutant 1 | Amino acid sequence of 1D05 kappa light chain with V to A back-mutation in CDRL2 to germline highlighted | DIQMTQSPSSLSASVGDRVTITCRASQSISSYLNWYQQKPGKAPKLLIY AASSLQSGVPSRFSGSGSGTDFTLTISSLQPEDFATYYCQQSYSTPITF GQGTRLEIKRTVAAPSVFIFPPSDEQLKSGTASVVCLLNNFYPREAKVQ WKVDNALQSGNSQESVTEQDSKDSTYSLSSTLTLSKADYEKHKVYACEV THQGLSSPVTKSFNRGEC |
| 51 | Mutated 1D05-LC mutant 2 | Amino acid sequence of 1D05 kappa light chain with L to F back-mutation in framework to germline highlighted | DIQMTQSPSSLSASVGDRVTITCRASQSISSYLNWYQQKPGKAPKLFIY VASSLQSGVPSRFSGSGSGTDFTLTISSLQPEDFATYYCQQSYSTPITF GQGTRLEIKRTVAAPSVFIFPPSDEQLKSGTASVVCLLNNFYPREAKVQ WKVDNALQSGNSQESVTEQDSKDSTYSLSSTLTLSKADYEKHKVYACEV THQGLSSPVTKSFNRGEC |
| 52 | 411B08-CDRH1 (IMGT) | Amino acid sequence of CDRH1 of 411B08 using IMGT | GFTFSSYW |
| 53 | 411B08-CDRH2 (IMGT) | Amino acid sequence of CDRH2 of 411B08 using IMGT | IKEDGSEK |
| 54 | 411B08-CDRH3 (IMGT) | Amino acid sequence of CDRH3 of 411B08 using IMGT | ARNRLYSDFLDN |
| 55 | 411B08-CDRH1 (Kabat) | Amino acid sequence of CDRH1 of 411B08 using Kabat | SYWMS |
| 56 | 411B08-CDRH2 (Kabat) | Amino acid sequence of CDRH2 of 411B08 using Kabat | NIKEDGSEKYYVDSVKG |
| 57 | 411B08-CDRH3 (Kabat) | Amino acid sequence of CDRH3 of 411B08 using Kabat | NRLYSDFLDN |
| 58 | 411B08-Heavy chain variable region | Amino acid sequence of $V_H$ of 411B08 | EVQLVESGGGLVQPGGSLRLSCAASGFTFSSYWMSWVRQAPGKGLEWVA NIKEDGSEKYYVDSVKGRFTISRDNAKNSLYLQMNSLRAEDTSVYYCAR NRLYSDFLDNWGQGTLVTVSS |
| 59 | 411B08-Heavy chain variable region | Nucleic acid sequence of $V_H$ of 411B08 | GAGGTGCAGCTGGTGGAGTCTGGGGGAGGCTTGGTCCAGCCTGGGGGGT CCCTGAGACTCTCCTGTGCAGCCTCTGGATTCACGTTTAGTAGCTATTG GATGAGTTGGGTCCGCCAGGCTCCAGGGAAGGGGCTGGAGTGGGTGGCC AACATCAAAGAAGATGGAAGTGAGAAATACTATGTCGACTCTGTGAAGG GCCGATTCACCATCTCCAGAGACAACGCCAAGAACTCACTGTATCTGCA AATGAACAGCCTGAGAGCCGAGGACACGTCTGTGTATTACTGTGCGAGA AATCGACTCTACAGTGACTTCCTTGACAACTGGGGCCAGGGAACCCTGG TCACCGTCTCCTCAG |
| 60 | 411B08-full of 411B08 heavy chain sequence | Amino acid sequence of 411B08 heavy chain | EVQLVESGGGLVQPGGSLRLSCAASGFTFSSYWMSWVRQAPGKGLEWVA NIKEDGSEKYYVDSVKGRFTISRDNAKNSLYLQMNSLRAEDTSVYYCAR NRLYSDFLDNWGQGTLVTVSSASTKGPSVFPLAPSSKSTSGGTAALGCL VKDYFPEPVTVSWNSGALTSGVHTFPAVLQSSGLYSLSSVVTVPSSSLG TQTYICNVNHKPSNTKVDKKVEPKSCDKTHTCPPCPAPELLGGPSVFLF |

TABLE S1 -continued

SEQ ID NOS: 1-342

| SEQ ID NO: | Name | Description | Sequence |
|---|---|---|---|
| | | | PPKPKDTLMISRTPEVTCVVVDVSHEDPEVKFNWYVDGVEVHNAKTKPR EEQYNSTYRVVSVLTVLHQDWLNGKEYKCKVSNKALPAPIEKTISKAKG QPREPQVYTLPPSRDELTKNQVSLTCLVKGFYPSDIAVEWESNGQPENN YKTTPPVLDSDGSFFLYSKLTVDKSRWQQGNVFSCSVMHEALHNHYTQK SLSLSPGK |
| 61 | 411B08-full heavy chain sequence | Nucleic acid sequence of 411B08 heavy chain | GAGGTGCAGCTGGTGGAGTCTGGGGGAGGCTTGGTCCAGCCTGGGGGGT CCCTGAGACTCTCCTGTGCAGCCTCTGGATTCACGTTTAGTAGCTATTG GATGAGTTGGGTCCGCCAGGCTCCAGGGAAGGGGCTGGAGTGGGTGGCC AACATCAAAGAAGATGGAAGTGAGAAATACTATGTCGACTCTGTGAAGG GCCGATTCACCATCTCCAGAGACAACGCCAAGAACTCACTGTATCTGCA AATGAACAGCCTGAGAGCCGAGGACACGTCTGTGTATTACTGTGCGAGA AATCGACTCTACAGTGACTTCCTTGACAACTGGGGCCAGGGAACCCTGG TCACCGTCTCCTCAGCCAGCACCAAGGGCCCCTCTGTGTTCCCTCTGGC CCCTTCCAGCAAGTCCACCTCTGGCGGAACAGCCGCTCTGGGCTGCCTC GTGAAGGACTACTTCCCCGAGCCTGTGACCGTGTCCTGGAACTCTGGCG CTCTGACCAGCGGAGTGCACACCTTCCCTGCTGTGCTGCAGTCCTCCGG CCTGTACTCCCTGTCCTCCGTCGTGACCGTGCCTTCCAGCTCTCTGGGC ACCCAGACCTACATCTGCAACGTGAACCACAAGCCCTCCAACACCAAGG TGGACAAGAAGGTGGAACCCAAGTCCTGCGACAAGACCCACACCTGTCC CCCTTGTCCTGCCCCTGAACTGCTGGGCGGACCTTCCGTGTTCCTGTTC CCCCCAAAGCCCAAGGACACCCTGATGATCTCCCGGACCCCCGAAGTGA CCTGCGTGGTGGTGGATGTGTCCCACGAGGACCCTGAAGTGAAGTTCAA TTGGTACGTGGACGGCGTGGAAGTGCACAACGCCAAGACCAAGCCTAGA GAGGAACAGTACAACTCCACCTACCGGGTGGTGTCCGTGCTGACCGTGC TGCACCAGGATTGGCTGAACGGCAAGAGTACAAGTGCAAGGTGTCCAA CAAGGCCCTGCCTGCCCCCATCGAAAAGACCATCTCCAAGGCCAAGGGC CAGCCCCGGGAACCCCAGGTGTACACACTGCCCCCTAGCAGGGACGAGC TGACCAAGAACCAGGTGTCCCTGACCTGTCTCGTGAAAGGCTTCTACCC CTCCGATATCGCCGTGGAATGGGAGTCCAACGGCCAGCCTGAGAACAAC TACAAGACCACCCCCCCTGTGCTGGACTCCGACGGCTCATTCTTCCTGT ACAGCAAGCTGACAGTGGACAAGTCCCGGTGGCAGCAGGGCAACGTGTT CTCCTGCTCCGTGATGCACGAGGCCCTGCACAACCACTACACCCAGAAG TCCCTGTCCCTGAGCCCCGGCAAG |
| 62 | 411B08-CDRL1 (IMGT) | Amino acid sequence of CDRL1 of 411B08 using IMGT | QGVSSW |
| 63 | 411B08-CDRL2 (IMGT) | Amino acid sequence of CDRL2 of 411B08 using IMGT | GAS |
| 64 | 411B08-CDRL3 (IMGT) | Amino acid sequence of CDRL3 of 411B08 using IMGT | QQANSIPFT |
| 65 | 411B08-CDRL1 (Kabat) | Amino acid sequence of CDRL1 of 411B08 using Kabat | RASQGVSSWLA |
| 66 | 411B08-CDRL2 (Kabat) | Amino acid sequence of CDRL2 of 411B08 using Kabat | GASSLQS |
| 67 | 411B08-CDRL3 (Kabat) | Amino acid sequence of CDRL3 of 411B08 using Kabat | QQANSIPFT |
| 68 | 411B08-Light chain variable region | Amino acid sequence of VL of 411B08 | DIQMTQSPSSVSASVGDRVTITCRASQGVSSWLAWYQQKSGKAPKLLIY GASSLQSGVPSRFSGSGSGTEFILTISSLQPEDFATYYCQQANSIPFTF GPGTKVDIK |
| 69 | 411B08-Light chain variable region | Nucleic acid sequence of $V_L$ of 411B08 | GACATCCAGATGACCCAGTCTCCATCTTCCGTGTCTGCATCTGTCGGAG ACAGAGTCACCATCACTTGTCGGGCGAGTCAGGGTGTTAGCAGCTGGTT AGCCTGGTATCAGCAGAAATCAGGGAAAGCCCCTAAGCTCCTGATCTAT GGTGCATCCAGTTTGCAAAGTGGGGTCCCATCAAGATTCAGCGGCAGTG GATCTGGGACAGAGTTCATTCTCACCATCAGCAGCCTGCAGCCTGAAGA TTTTGCAACTTACTATTGTCAACAGGCTAACAGTATCCCATTCACTTTC GGCCCTGGGACCAAAGTGGATATCAAAC |

TABLE S1 -continued

SEQ ID NOS: 1-342

| SEQ ID NO: | Name | Description | Sequence |
|---|---|---|---|
| 70 | 411B08-full light chain sequence | Amino acid sequence of 411B08 light chain | DIQMTQSPSSVSASVGDRVTITCRASQGVSSWLAWYQQKSGKAPKLLIY GASSLQSGVPSRFSGSGSGTEFILTISSLQPEDFATYYCQQANSIPFTF GPGTKVDIKRTVAAPSVFIFPPSDEQLKSGTASVVCLLNNFYPREAKVQ WKVDNALQSGNSQESVTEQDSKDSTYSLSSTLTLSKADYEKHKVYACEV THQGLSSPVTKSFNRGEC |
| 71 | 411B08-full light chain sequence | Nucleic acid sequence of 411B08 light chain | GACATCCAGATGACCCAGTCTCCATCTTCCGTGTCTGCATCTGTCGGAG ACAGAGTCACCATCACTTGTCGGGCGAGTCAGGGTGTTAGCAGCTGGTT AGCCTGGTATCAGCAGAAATCAGGGAAAGCCCCTAAGCTCCTGATCTAT GGTGCATCCAGTTTGCAAAGTGGGGTCCCATCAAGATTCAGCGGCAGTG GATCTGGGACAGAGTTCATTCTCACCATCAGCAGCCTGCAGCCTGAAGA TTTTGCAACTTACTATTGTCAACAGGCTAACAGTATCCCATTCACTTTC GGCCCTGGGACCAAAGTGGATATCAAACGTACGGTGGCCGCTCCCTCCG TGTTCATCTTCCCACCTTCCGACGAGCAGCTGAAGTCCGGCACCGCTTC TGTCGTGTGCCTGCTGAACAACTTCTACCCCCGCGAGGCCAAGGTGCAG TGGAAGGTGGACAACGCCCTGCAGTCCGGCAACTCCCAGGAATCCGTGA CCGAGCAGGACTCCAAGGACAGCACCTACTCCCTGTCCTCCACCCTGAC CCTGTCCAAGGCCGACTACGAGAAGCACAAGGTGTACGCCTGCGAAGTG ACCCACCAGGGCCTGTCTAGCCCCGTGACCAAGTCTTTCAACCGGGGCG AGTGT |
| 72 | 411C04-CDRH1 (IMGT) | Amino acid sequence of CDRH1 of 411C04 using IMGT | GFTFSSYW |
| 73 | 411C04-CDRH2 (IMGT) | Amino acid sequence of CDRH2 of 411C04 using IMGT | IKEDGSEK |
| 74 | 411C04-CDRH3 (IMGT) | Amino acid sequence of CDRH3 of 411C04 using IMGT | ARVRLYSDFLDY |
| 75 | 411C04-CDRH1 (Kabat) | Amino acid sequence of CDRH1 of 411C04 using Kabat | SYWMS |
| 76 | 411C04-CDRH2 (Kabat) | Amino acid sequence of CDRH2 of 411C04 using Kabat | NIKEDGSEKYYVDSLKG |
| 77 | 411C04-CDRH3 (Kabat) | Amino acid sequence of CDRH3 of 411C04 using Kabat | VRLYSDFLDY |
| 78 | 411C04-Heavy chain variable region | Amino acid sequence of $V_H$ of 411C04 | EVQLVDSGGGLVQPGGSLRLSCAASGFTFSSYWMSWVRQAPGKGLEWVA NIKEDGSEKYYVDSLKGRFTISRDNAKNSLYLQMNSLRAEDTSVYYCAR VRLYSDFLDYWGQGTLVTVSS |
| 79 | 411C04-Heavy chain variable region | Nucleic acid sequence of $V_H$ of 411C04 | GAGGTGCAGCTGGTGGACTCTGGGGGAGGCTTGGTCCAGCCTGGGGGGT CCCTGAGACTCTCCTGTGCAGCCTCTGGATTCACGTTTAGTAGCTATTG GATGAGTTGGGTCCGCCAGGCTCCAGGAAAGGGGCTGGAGTGGGTGGCC AACATAAAAGAAGATGGAAGTGAGAAATACTATGTAGACTCTTTGAAGG GCCGATTCACCATCTCCAGAGACAACGCCAAGAACTCACTGTATCTGCA AATGAACAGCCTGAGAGCCGAGGACACGTCTGTGTATTACTGTGCGAGA GTTCGACTCTACAGTGACTTCCTTGACTACTGGGGCCAGGGAACCCTGG TCACCGTCTCCTCAG |
| 80 | 411C04-full heavy chain sequence | Amino acid sequence of 411C04 heavy chain | EVQLVDSGGGLVQPGGSLRLSCAASGFTFSSYWMSWVRQAPGKGLEWVA NIKEDGSEKYYVDSLKGRFTISRDNAKNSLYLQMNSLRAEDTSVYYCAR VRLYSDFLDYWGQGTLVTVSSASTKGPSVFPLAPSSKSTSGGTAALGCL VKDYFPEPVTVSWNSGALTSGVHTFPAVLQSSGLYSLSSVVTVPSSSLG TQTYICNVNHKPSNTKVDKKVEPKSCDKTHTCPPCPAPELLGGPSVFLF PPKPKDTLMISRTPEVTCVVVDVSHEDPEVKFNWYVDGVEVHNAKTKPR EEQYNSTYRVVSVLTVLHQDWLNGKEYKCKVSNKALPAPIEKTISKAKG QPREPQVYTLPPSRDELTKNQVSLTCLVKGFYPSDIAVEWESNGQPENN YKTTPPVLDSDGSFFLYSKLTVDKSRWQQGNVFSCSVMHEALHNHYTQK SLSLSPGK |

TABLE S1 -continued

SEQ ID NOS: 1-342

| SEQ ID NO: | Name | Description | Sequence |
|---|---|---|---|
| 81 | 411C04-full heavy chain sequence | Nucleic acid sequence of 411C04 heavy chain | GAGGTGCAGCTGGTGGACTCTGGGGGAGGCTTGGTCCAGCCTGGGGGGT CCCTGAGACTCTCCTGTGCAGCCTCTGGATTCACGTTTAGTAGCTATTG GATGAGTTGGGTCCGCCAGGCTCCAGGGAAGGGGCTGGAGTGGGTGGCC AACATAAAAGAAGATGGAAGTGAGAAATACTATGTAGACTCTTTGAAGG GCCGATTCACCATCTCCAGAGACAACGCCAAGAACTCACTGTATCTGCA AATGAACAGCCTGAGAGCCGAGGACACGTCTGTGTATTACTGTGCGAGA GTTCGACTCTACAGTGACTTCCTTGACTACTGGGGCCAGGGAACCCTGG TCACCGTCTCCTCAGCCAGCACCAAGGGCCCCTCTGTGTTCCCTCTGGC CCCTTCCAGCAAGTCCACCTCTGGCGGAACAGCCGCTCTGGGCTGCCTC GTGAAGGACTACTTCCCCGAGCCTGTGACCGTGTCCTGGAACTCTGGCG CTCTGACCAGCGGAGTGCACACCTTCCCTGCTGTGCTGCAGTCCTCCGG CCTGTACTCCCTGTCCTCCGTCGTGACCGTGCCTTCCAGCTCTCTGGGC ACCCAGACCTACATCTGCAACGTGAACCACAAGCCCTCCAACACCAAGG TGGACAAGAAGGTGGAACCCAAGTCCTGCGACAAGACCCACACCTGTCC CCCTTGTCCTGCCCCTGAACTGCTGGGCGGACCTTCCGTGTTCCTGTTC CCCCCAAAGCCCAAGGACACCCTGATGATCTCCCGGACCCCCGAAGTGA CCTGCGTGGTGGTGGATGTGTCCCACGAGGACCCTGAAGTGAAGTTCAA TTGGTACGTGGACGGCGTGGAAGTGCACAACGCCAAGACCAAGCCTAGA GAGGAACAGTACAACTCCACCTACCGGGTGGTGTCCGTGCTGACCGTGC TGCACCAGGATTGGCTGAACGGCAAAGAGTACAAGTGCAAGGTGTCCAA CAAGGCCCTGCCTGCCCCCATCGAAAAGACCATCTCCAAGGCCAAGGGC CAGCCCCGGGAACCCCAGGTGTACACCTGCCCCCTAGCAGGGACGAGC TGACCAAGAACCAGGTGTCCCTGACCTGTCTCGTGAAAGGCTTCTACCC CTCCGATATCGCCGTGGAATGGGAGTCCAACGGCCAGCCTGAGAACAAC TACAAGACCACCCCCCCTGTGCTGGACTCCGACGGCTCATTCTTCCTGT ACAGCAAGCTGACAGTGGACAAGTCCCGGTGGCAGCAGGGCAACGTGTT CTCCTGCTCCGTGATGCACGAGGCCCTGCACAACCACTACACCCAGAAG TCCCTGTCCCTGAGCCCCGGCAAG |
| 82 | 411C04-CDRL1 (IMGT) | Amino acid sequence of CDRL1 of 411C04 using IMGT | QGVSSW |
| 83 | 411C04-CDRL2 (IMGT) | Amino acid sequence of CDRL2 of 411C04 using IMGT | GAS |
| 84 | 411C04-CDRL3 (IMGT) | Amino acid sequence of CDRL3 of 411C04 using IMGT | QQANSIPFT |
| 85 | 411C04-CDRL1 (Kabat) | Amino acid sequence of CDRL1 of 411C04 using Kabat | RASQGVSSWLA |
| 86 | 411C04-CDRL2 (Kabat) | Amino acid sequence of CDRL2 of 411C04 using Kabat | GASSLQS |
| 87 | 411C04-CDRL3 (Kabat) | Amino acid sequence of CDRL3 of 411C04 using Kabat | QQANSIPFT |
| 88 | 411C04-Light chain variable region | Amino acid sequence of $V_L$ of 411C04 | DIQMTQSPSSVSASVGDRVTITCRASQGVSSWLAWYQQKSGKAPKLLIY GASSLQSGVPSRFSGSGSGTEFILSISSLQPEDFATYYCQQANSIPFTF GPGTKVDIK |
| 89 | 411C04-Light chain variable region | Nucleic acid sequence of $V_L$ of 411C04 | GACATCCAGATGACCCAGTCTCCATCTTCCGTGTCTGCATCTGTCGGAG ACAGAGTCACCATCACTTGTCGGGCGAGTCAGGGTGTTAGCAGTTGGTT AGCCTGGTATCAGCAGAAATCAGGGAAAGCCCCTAAGCTCCTGATCTAT GGTGCCTCCAGTTTGCAAAGTGGGGTCCCATCAAGATTCAGCGGCAGTG GATCTGGGACAGAGTTCATTCTCAGCATCAGCAGCCTGCAGCCTGAAGA TTTTGCAACTTACTATTGTCAACAGGCTAACAGTATCCCATTCACTTTC GGCCCTGGGACCAAAGTGGATATCAAAC |
| 90 | 411C04-full light chain sequence | Amino acid sequence of 411C04 light chain | DIQMTQSPSSVSASVGDRVTITCRASQGVSSWLAWYQQKSGKAPKLLIY GASSLQSGVPSRFSGSGSGTEFILSISSLQPEDFATYYCQQANSIPFTF GPGTKVDIKRTVVAAPSVFIFPPSDEQLKSGTASVVCLLNNFY-PREAKVQ WKVDNALQSGNSQESVTEQDSKDSTYSLSSTLTLSKADYEKHKVYACE THQGLSSPVTKSFNRGEC |

TABLE S1 -continued

SEQ ID NOS: 1-342

| SEQ ID NO: | Name | Description | Sequence |
|---|---|---|---|
| 91 | 411C04-full light chain sequence | Nucleic acid sequence of 411C04 light chain | GACATCCAGATGACCCAGTCTCCATCTTCCGTGTCTGCATCTGTCGGAG ACAGAGTCACCATCACTTGTCGGGCGAGTCAGGGTGTTAGCAGTTGGTT AGCCTGGTATCAGCAGAAATCAGGGAAAGCCCCTAAGCTCCTGATCTAT GGTGCCTCCAGTTTGCAAAGTGGGGTCCCATCAAGATTCAGCGGCAGTG GATCTGGGACAGAGTTCATTCTCAGCATCAGCAGCCTGCAGCCTGAAGA TTTTGCAACTTACTATTGTCAACAGGCTAACAGTATCCCATTCACTTTC GGCCCTGGGACCAAAGTGGATATCAAACGTACGGTGGCCGCTCCCTCCG TGTTCATCTTCCCACCTTCCGACGAGCAGCTGAAGTCCGGCACCGCTTC TGTCGTGTGCCTGCTGAACAACTTCTACCCCCGCGAGGCCAAGGTGCAG TGGAAGGTGGACAACGCCCTGCAGTCCGGCAACTCCCAGGAATCCGTGA CCGAGCAGGACTCCAAGGACAGCACCTACTCCCTGTCCTCCACCCTGAC CCTGTCCAAGGCCGACTACGAGAAGCACAAGGTGTACGCCTGCGAAGTG ACCCACCAGGGCCTGTCTAGCCCCGTGACCAAGTCTTTCAACCGGGGCG AGTGT |
| 92 | 411D07-CDRH1 (IMGT) | Amino acid sequence of CDRH1 of 411D07 using IMGT | GGSIISSDW |
| 93 | 411D07-CDRH2 (IMGT) | Amino acid sequence of CDRH2 of 411D07 using IMGT | IFHSGRT |
| 94 | 411D07-CDRH3 (IMGT) | Amino acid sequence of CDRH3 of 411D07 using IMGT | ARDGSGSY |
| 95 | 411D07-CDRH1 (Kabat) | Amino acid sequence of CDRH1 of 411D07 using Kabat | SSDWWN |
| 96 | 411D07-CDRH2 (Kabat) | Amino acid sequence of CDRH2 of 411D07 using Kabat | EIFHSGRTNYNPSLKS |
| 97 | 411D07-CDRH3 (Kabat) | Amino acid sequence of CDRH3 of 411D07 using Kabat | DGSGSY |
| 98 | 411D07-Heavy chain variable region | Amino acid sequence of V$_H$ of 411D07 | QVQLQESGPGLVKPSGTLSLTCIVSGGSIISSDWWNWVRQPPGKGLEWI GEIFHSGRTNYNPSLKSRVTISIDKSKNQFSLRLSSVTAADTAVYYCAR DGSGSYWGQGTLVTVSS |
| 99 | 411D07-Heavy chain variable region | Nucleic acid sequence of V$_H$ of 411D07 | CAGGTGCAGCTGCAGGAGTCGGGCCCAGGACTGGTGAAGCCTTCGGGGA CCCTGTCCCTCACCTGCATTGTCTCTGGTGGCTCCATCATCAGTAGTGA CTGGTGGAATTGGGTCCGCCAGCCCCCAGGGAAGGGGCTGGAGTGGATT GGAGAAATCTTTCATAGTGGGAGGACCAACTACAACCCGTCCCTCAAGA GTCGAGTCACCATATCAATAGACAAGTCCAAGAATCAGTTCTCCCTGAG GCTGAGCTCTGTGACCGCCGCGGACACGGCCGTGTATTACTGTGCGAGA GATGGTTCGGGGAGTTACTGGGGCCAGGGAACCCTGGTCACCGTCTCCT CAG |
| 100 | 411D07-full heavy chain sequence | Amino acid sequence of 411D07 heavy chain | QVQLQESGPGLVKPSGTLSLTCIVSGGSIISSDWWNWVRQPPGKGLEWI GEIFHSGRTNYNPSLKSRVTISIDKSKNQFSLRLSSVTAADTAVYYCAR DGSGSYWGQGTLVTVSSASTKGPSVFPLAPSSKSTSGGTAALGCLVKDY FPEPVTVSWNSGALTSGVHTFPAVLQSSGLYSLSSVVTVPSSSLGTQTY ICNVNHKPSNTKVDKKVEPKSCDKTHTCPPCPAPELLGGPSVFLFPPKP KDTLMISRTPEVTCVVVDVSHEDPEVKFNWYVDGVEVHNAKTKPREEQY NSTYRVVSVLTVLHQDWLNGKEYKCKVSNKALPAPIEKTISKAKGQPRE PQVYTLPPSRDELTKNQVSLTCLVKGFYPSDIAVEWESNGQPENNYKTT PPVLDSDGSFFLYSKLTVDKSRWQQGNVFSCSVMHEALHNHYTQKSLSL SPGK |
| 101 | 411D07-full heavy chain sequence | Nucleic acid sequence of 411D07 heavy chain | CAGGTGCAGCTGCAGGAGTCGGGCCCAGGACTGGTGAAGCCTTCGGGGA CCCTGTCCCTCACCTGCATTGTCTCTGGTGGCTCCATCATCAGTAGTGA CTGGTGGAATTGGGTCCGCCAGCCCCCAGGGAAGGGGCTGGAGTGGATT GGAGAAATCTTTCATAGTGGGAGGACCAACTACAACCCGTCCCTCAAGA GTCGAGTCACCATATCAATAGACAAGTCCAAGAATCAGTTCTCCCTGAG GCTGAGCTCTGTGACCGCCGCGGACACGGCCGTGTATTACTGTGCGAGA GATGGTTCGGGGAGTTACTGGGGCCAGGGAACCCTGGTCACCGTCTCCT CAGCCAGCACCAAGGGCCCCTCTGTGTTCCCTCTGGCCCCTTCCAGCAA GTCCACCTCTGGCGGAACAGCCGCTCTGGGCTGCCTCGTGAAGGACTAC |

US 9,957,323 B2

TABLE S1 -continued

SEQ ID NOS: 1-342

| SEQ ID NO:Name | Description | Sequence |
|---|---|---|
| | | TTCCCCGAGCCTGTGACCGTGTCCTGGAACTCTGGCGCTCTGACCAGCG<br>GAGTGCACACCTTCCCTGCTGTGCTGCAGTCCTCCGGCCTGTACTCCCT<br>GTCCTCCGTCGTGACCGTGCCTTCCAGCTCTCTGGGCACCCAGACCTAC<br>ATCTGCAACGTGAACCACAAGCCCTCCAACACCAAGGTGGACAAGAAGG<br>TGGAACCCAAGTCCTGCGACAAGACCCACACCTGTCCCCCTTGTCCTGC<br>CCCTGAACTGCTGGGCGGACCTTCCGTGTTCCTGTTCCCCCCAAAGCCC<br>AAGGACACCCTGATGATCTCCCGGACCCCCGAAGTGACCTGCGTGGTGG<br>TGGATGTGTCCCACGAGGACCCTGAAGTGAAGTTCAATTGGTACGTGGA<br>CGGCGTGGAAGTGCACAACGCCAAGACCAAGCCTAGAGAGGAACAGTAC<br>AACTCCACCTACCGGGTGGTGTCCGTGCTGACCGTGCTGCACCAGGATT<br>GGCTGAACGGCAAAGAGTACAAGTGCAAGGTGTCCAACAAGGCCCTGCC<br>TGCCCCCATCGAAAAGACCATCTCCAAGGCCAAGGGCCAGCCCCGGGAA<br>CCCCAGGTGTACACACTGCCCCCTAGCAGGGACGAGCTGACCAAGAACC<br>AGGTGTCCCTGACCTGTCTCGTGAAAGGCTTCTACCCCTCCGATATCGC<br>CGTGGAATGGGAGTCCAACGGCCAGCCTGAGAACAACTACAAGACCACC<br>CCCCCTGTGCTGGACTCCGACGGCTCATTCTTCCTGTACAGCAAGCTGA<br>CAGTGGACAAGTCCCGGTGGCAGCAGGGCAACGTGTTCTCCTGCTCCGT<br>GATGCACGAGGCCCTGCACAACCACTACACCCAGAAGTCCCTGTCCCTG<br>AGCCCCGGCAAG |
| 102 411D07-CDRL1 (IMGT) | Amino acid sequence of CDRL1 of 411D07 using IMGT | QSVLYSSNNKNY |
| 103 411D07-CDRL2 (IMGT) | Amino acid sequence of CDRL2 of 411D07 using IMGT | WAS |
| 104 411D07-CDRL3 (IMGT) | Amino acid sequence of CDRL3 of 411D07 using IMGT | QQYYSNRS |
| 105 411D07-CDRL1 (Kabat) | Amino acid sequence of CDRL1 of 411D07 using Kabat | KSSQSVLYSSNNKNYLA |
| 106 411D07-CDRL2 (Kabat) | Amino acid sequence of CDRL2 of 411D07 using Kabat | WASTRES |
| 107 411D07-CDRL3 (Kabat) | Amino acid sequence of CDRL3 of 411D07 using Kabat | QQYYSNRS |
| 108 411D07-Light chain variable region | Amino acid sequence of V_L of 411D07 | DIVMTQSPDSLAVSLGERATINCKSSQSVLYSSNNKNYLAWYQQKSGQP<br>PKLLIYWASTRESGVPDRFSGSGSGTDFTLTISSLQTEDVAVYYCQQYY<br>SNRSFGQGTKLEIK |
| 109 411D07-Light chain variable region | Nucleic acid sequence of V_L of 411D07 | GACATCGTGATGACCCAGTCTCCAGACTCCCTGGCTGTGTCTCTGGGCG<br>AGAGGGCCACCATCAACTGCAAGTCCAGCCAGAGTGTTTTATACAGCTC<br>CAACAATAAGAATTACTTAGCTTGGTACCAGCAGAAATCAGGACAGCCT<br>CCTAAGTTGCTCATTTACTGGGCATCTACCCGGGAATCCGGGGTCCCTG<br>ACCGATTCAGTGGCAGCGGGTCTGGGACAGATTTCACTCTCACCATCAG<br>CAGCCTGCAGACTGAAGATGTGGCAGTTTATTACTGTCAGCAATATTAT<br>AGTAATCGCAGTTTTGGCCAGGGGACCAAGCTGGAGATCAAAC |
| 110 411D07-full light chain sequence | Amino acid sequence of 411D07 light chain | DIVMTQSPDSLAVSLGERATINCKSSQSVLYSSNNKNYLAWYQQKSGQP<br>PKLLIYWASTRESGVPDRFSGSGSGTDFTLTISSLQTEDVAVYYCQQYY<br>SNRSFGQGTKLEIKRTVAAPSVFIFPPSDEQLKSGTASVVCLLNNFYPR<br>EAKVQWKVDNALQSGNSQESVTEQDSKDSTYSLSSTLTLSKADYEKHKV<br>YACEVTHQGLSSPVTKSFNRGEC |
| 111 411D07-full light chain sequence | Nucleic acid sequence of 411D07 light chain | GACATCGTGATGACCCAGTCTCCAGACTCCCTGGCTGTGTCTCTGGGCG<br>AGAGGGCCACCATCAACTGCAAGTCCAGCCAGAGTGTTTTATACAGCTC<br>CAACAATAAGAATTACTTAGCTTGGTACCAGCAGAAATCAGGACAGCCT<br>CCTAAGTTGCTCATTTACTGGGCATCTACCCGGGAATCCGGGGTCCCTG<br>ACCGATTCAGTGGCAGCGGGTCTGGGACAGATTTCACTCTCACCATCAG<br>CAGCCTGCAGACTGAAGATGTGGCAGTTTATTACTGTCAGCAATATTAT<br>AGTAATCGCAGTTTTGGCCAGGGGACCAAGCTGGAGATCAAACGTACGG<br>TGGCCGCTCCCTCCGTGTTCATCTTCCCACCTTCCGACGAGCAGCTGAA<br>GTCCGGCACCGCTTCTGTCGTGTGCCTGCTGAACAACTTCTACCCCCGC<br>GAGGCCAAGGTGCAGTGGAAGGTGGACAACGCCCTGCAGTCCGGCAACT |

TABLE S1 -continued

SEQ ID NOS: 1-342

| SEQ ID NO: | Name | Description | Sequence |
|---|---|---|---|
| | | | CCCAGGAATCCGTGACCGAGCAGGACTCCAAGGACAGCACCTACTCCCT GTCCTCCACCCTGACCCTGTCCAAGGCCGACTACGAGAAGCACAAGGTG TACGCCTGCGAAGTGACCCACCAGGGCCTGTCTAGCCCCGTGACCAAGT CTTTCAACCGGGGCGAGTGT |
| 112 | 385F01-CDRH1 (IMGT) | Amino acid sequence of CDRH1 of 385F01 using IMGT | GFTFSSYW |
| 113 | 385F01-CDRH2 (IMGT) | Amino acid sequence of CDRH2 of 385F01 using IMGT | IKEDGSEK |
| 114 | 385F01-CDRH3 (IMGT) | Amino acid sequence of CDRH3 of 385F01 using IMGT | ARNRLYSDFLDN |
| 115 | 385F01-CDRH1 (Kabat) | Amino acid sequence of CDRH1 of 385F01 using Kabat | SYWMS |
| 116 | 385F01-CDRH2 (Kabat) | Amino acid sequence of CDRH2 of 385F01 using Kabat | NIKEDGSEKYYVDSVKG |
| 117 | 385F01-CDRH3 (Kabat) | Amino acid sequence of CDRH3 of 385F01 using Kabat | NRLYSDFLDN |
| 118 | 385F01-Heavy chain variable region | Amino acid sequence of $V_H$ of 385F01 | EVQLVESGGGLVQPGGSLRLSCAASGFTFSSYWMSWVRQAPGKGLEWVA NIKEDGSEKYYVDSVKGRFTISRDNAKNSLYLQMNSLRAEDTSVYYCAR NRLYSDFLDNWGQGTLVTVSS |
| 119 | 385F01-Heavy chain variable region | Nucleic acid sequence of $V_H$ of 385F01 | GAGGTGCAGCTGGTGGAGTCTGGGGGAGGCTTGGTCCAGCCTGGGGGGT CCCTGAGACTCTCCTGTGCAGCCTCTGGATTCACGTTTAGTAGCTATTG GATGAGTTGGGTCCGCCAGGCTCCAGGGAAGGGGCTGGAGTGGGTGGCC AACATCAAAGAAGATGGAAGTGAGAAATACTATGTCGACTCTGTGAAGG GCCGATTCACCATCTCCAGAGACAACGCCAAGAACTCACTGTATCTGCA AATGAACAGCCTGAGAGCCGAGGACACGTCTGTGTATTACTGTGCGAGA AATCGACTCTACAGTGACTTCCTTGACAACTGGGGCCAGGGAACCCTGG TCACCGTCTCCTCAG |
| 120 | 385F01-full heavy chain sequence | Amino acid sequence of 385F01 heavy chain | EVQLVESGGGLVQPGGSLRLSCAASGFTFSSYWMSWVRQAPGKGLEWVA NIKEDGSEKYYVDSVKGRFTISRDNAKNSLYLQMNSLRAEDTSVYYCAR NRLYSDFLDNWGQGTLVTVSSASTKGPSVFPLAPSSKSTSGGTAALGCL VKDYFPEPVTVSWNSGALTSGVHTFPAVLQSSGLYSLSSVVTVPSSSLG TQTYICNVNHKPSNTKVDKKVEPKSCDKTHTCPPCPAPELLGGPSVFLF PPKPKDTLMISRTPEVTCVVVDVSHEDPEVKFNWYVDGVEVHNAKTKPR EEQYNSTYRVVSVLTVLHQDWLNGKEYKCKVSNKALPAPIEKTISKAKG QPREPQVYTLPPSRDELTKNQVSLTCLVKGFYPSDIAVEWESNGQPENN YKTTPPVLDSDGSFFLYSKLTVDKSRWQQGNVFSCSVMHEALHNHYTQK SLSLSPGK |
| 121 | 385F01-full heavy chain sequence | Nucleic acid sequence of 385F01 heavy chain | GAGGTGCAGCTGGTGGAGTCTGGGGGAGGCTTGGTCCAGCCTGGGGGGT CCCTGAGACTCTCCTGTGCAGCCTCTGGATTCACGTTTAGTAGCTATTG GATGAGTTGGGTCCGCCAGGCTCCAGGGAAGGGGCTGGAGTGGGTGGCC AACATCAAAGAAGATGGAAGTGAGAAATACTATGTCGACTCTGTGAAGG GCCGATTCACCATCTCCAGAGACAACGCCAAGAACTCACTGTATCTGCA AATGAACAGCCTGAGAGCCGAGGACACGTCTGTGTATTACTGTGCGAGA AATCGACTCTACAGTGACTTCCTTGACAACTGGGGCCAGGGAACCCTGG TCACCGTCTCCTCAGCCAGCACCAAGGGCCCCTCTGTGTTCCCTCTGGC CCCTTCCAGCAAGTCCACCTCTGGCGGAACAGCCGCTCTGGGCTGCCTC GTGAAGGACTACTTCCCCGAGCCTGTGACCGTGTCCTGGAACTCTGGCG CTCTGACCAGCGGAGTGCACACCTTCCCTGCTGTGCTGCAGTCCTCCGG CCTGTACTCCCTGTCCTCCGTCGTGACCGTGCCTTCCAGCTCTCTGGGC ACCCAGACCTACATCTGCAACGTGAACCACAAGCCCTCCAACACCAAGG TGGACAAGAAGGTGGAGCCCAAGTCCTGCGACAAGACCCACACCTGTCC CCCTTGTCCTGCCCCTGAACTGCTGGGCGGACCTTCCGTGTTCCTGTTC CCCCCAAAGCCCAAGGACACCCTGATGATCTCCCGGACCCCCGAAGTGA CCTGCGTGGTGGTGGATGTGTCCCACGAGGACCCTGAAGTGAAGTTCAA TTGGTACGTGGACGGCGTGGAAGTGCACAACGCCAAGACCAAGCCTAGA GAGGAACAGTACAACTCCACCTACCGGGTGGTGTCCGTGCTGACCGTGC |

TABLE S1 -continued

SEQ ID NOS: 1-342

| SEQ ID NO:Name | Description | Sequence |
|---|---|---|
| | | TGCACCAGGATTGGCTGAACGGCAAAGAGTACAAGTGCAAGGTGTCCAA<br>CAAGGCCCTGCCTGCCCCCATCGAAAAGACCATCTCCAAGGCCAAGGGC<br>CAGCCCCGGGAACCCCAGGTGTACACACTGCCCCCTAGCAGGGACGAGC<br>TGACCAAGAACCAGGTGTCCCTGACCTGTCTCGTGAAAGGCTTCTACCC<br>CTCCGATATCGCCGTGGAATGGGAGTCCAACGGCCAGCCTGAGAACAAC<br>TACAAGACCACCCCCCCTGTGCTGGACTCCGACGGCTCATTCTTCCTGT<br>ACAGCAAGCTGACAGTGGACAAGTCCCGGTGGCAGCAGGGCAACGTGTT<br>CTCCTGCTCCGTGATGCACGAGGCCCTGCACAACCACTACACCCAGAAG<br>TCCCTGTCCCTGAGCCCCGGCAAG |
| 122 385F01-CDRL1 (IMGT) | Amino acid sequence of CDRL1 of 385F01 using IMGT | QGVSSW |
| 123 385F01-CDRL2 (IMGT) | Amino acid sequence of CDRL2 of 385F01 using IMGT | GAS |
| 124 385F01-CDRL3 (IMGT) | Amino acid sequence of CDRL3 of 385F01 using IMGT | QQANSIPFT |
| 125 385F01-CDRL1 (Kabat) | Amino acid sequence of CDRL1 of 385F01 using Kabat | RASQGVSSWLA |
| 126 385F01-CDRL2 (Kabat) | Amino acid sequence of CDRL2 of 385F01 using Kabat | GASSLQS |
| 127 385F01-CDRL3 (Kabat) | Amino acid sequence of CDRL3 of 385F01 using Kabat | QQANSIPFT |
| 128 385F01-Light chain variable region | Amino acid sequence of $V_L$ of 385F01 | DIQMTQSPSSVSASVGDRVTITCRASQGVSSWLAWYQQKSGKAPKLLIY<br>GASSLQSGVPSRFSGSGSGTEFILTISSLQPEDFATYYCQQANSIPFTF<br>GPGTKVDIK |
| 129 385F01-Light chain variable region | Nucleic acid sequence of $V_L$ of 385F01 | GACATCCAGATGACCCAGTCTCCATCTTCCGTGTCTGCATCTGTCGGAG<br>ACAGAGTCACCATCACTTGTCGGGCGAGTCAGGGTGTTAGCAGCTGGTT<br>AGCCTGGTATCAGCAGAAATCAGGGAAAGCCCCTAAGCTCCTGATCTAT<br>GGTGCATCCAGTTTGCAAAGTGGGGTCCCATCAAGATTCAGCGGCAGTG<br>GATCTGGGACAGAGTTCATTCTCACCATCAGCAGCCTGCAGCCTGAAGA<br>TTTTGCAACTTACTATTGTCAACAGGCTAACAGTATCCCATTCACTTTC<br>GGCCCTGGGACCAAAGTGGATATCAAAC |
| 130 385F01-full light chain sequence | Amino acid sequence of 385F01 light chain | DIQMTQSPSSVSASVGDRVTITCRASQGVSSWLAWYQQKSGKAPKLLIY<br>GASSLQSGVPSRFSGSGSGTEFILTISSLQPEDFATYYCQQANSIPFTF<br>GPGTKVDIKRTVAAPSVFIFPPSDEQLKSGTASVVCLLNNFYPREAKVQ<br>WKVDNALQSGNSQESVTEQDSKDSTYSLSSTLTLSKADYEKHKVYACEV<br>THQGLSSPVTKSFNRGEC |
| 131 385F01-full light chain sequence | Nucleic acid sequence of 385F01 light chain | GACATCCAGATGACCCAGTCTCCATCTTCCGTGTCTGCATCTGTCGGAG<br>ACAGAGTCACCATCACTTGTCGGGCGAGTCAGGGTGTTAGCAGCTGGTT<br>AGCCTGGTATCAGCAGAAATCAGGGAAAGCCCCTAAGCTCCTGATCTAT<br>GGTGCATCCAGTTTGCAAAGTGGGGTCCCATCAAGATTCAGCGGCAGTG<br>GATCTGGGACAGAGTTCATTCTCACCATCAGCAGCCTGCAGCCTGAAGA<br>TTTTGCAACTTACTATTGTCAACAGGCTAACAGTATCCCATTCACTTTC<br>GGCCCTGGGACCAAAGTGGATATCAAACGTACGGTGGCCGCTCCCTCCG<br>TGTTCATCTTCCCACCTTCCGACGAGCAGCTGAAGTCCGGCACCGCTTC<br>TGTCGTGTGCCTGCTGAACAACTTCTACCCCCGCGAGGCCAAGGTGCAG<br>TGGAAGGTGGACAACGCCCTGCAGTCCGGCAACTCCCAGGAATCCGTGA<br>CCGAGCAGGACTCCAAGGACAGCACCTACTCCCTGTCCTCCACCCTGAC<br>CCTGTCCAAGGCCGACTACGAGAAGCACAAGGTGTACGCCTGCGAAGTG<br>ACCCACCAGGGCCTGTCTAGCCCCGTGACCAAGTCTTTCAACCGGGGCG<br>AGTGT |

TABLE S1 -continued

SEQ ID NOS: 1-342

| SEQ ID NO:Name | Description | Sequence |
|---|---|---|
| 132 413D08-CDRH1 (IMGT) | Amino acid sequence of CDRH1 of 413D08 using IMGT | GFTFRIYG |
| 133 413D08-CDRH2 (IMGT) | Amino acid sequence of CDRH2 of 413D08 using IMGT | IWYDGSNK |
| 134 413D08-CDRH3 (IMGT) | Amino acid sequence of CDRH3 of 413D08 using IMGT | ARDMDYFGMDV |
| 135 413D08-CDRH1 (Kabat) | Amino acid sequence of CDRH1 of 413D08 using Kabat | IYGMH |
| 136 413D08-CDRH2 (Kabat) | Amino acid sequence of CDRH2 of 413D08 using Kabat | VIWYDGSNKYYADSVKG |
| 137 413D08-CDRH3 (Kabat) | Amino acid sequence of CDRH3 of 413D08 using Kabat | DMDYFGMDV |
| 138 413D08-Heavy chain variable region | Amino acid sequence of $V_H$ of 413D08 | QVQLVESGGGVVQPGRSLRLSCAASGFTFRIYGMHWVRQAPGKGLEWVA VIWYDGSNKYYADSVKGRFTISRDNSDNTLYLQMNSLRAEDTAVYYCAR DMDYFGMDVWGQGTTVTVSS |
| 139 413D08-Heavy chain variable region | Nucleic acid sequence of $V_H$ of 413D08 | CAGGTGCAGCTGGTGGAGTCTGGGGGAGGCGTGGTCCAGCCTGGGAGGT CCCTGAGACTCTCCTGTGCAGCGTCTGGATTCACCTTCCGTATTTATGG CATGCACTGGGTCCGCCAGGCTCCAGGCAAGGGGCTGGAGTGGGTGGCA GTTATATGGTATGATGGAAGTAATAAATACTATGCTGACTCCGTGAAGG GCCGATTCACCATCTCCAGAGACAATTCCGACAACACGCTGTATCTGCA AATGAACAGCCTGAGAGCCGAGGACACGGCTGTGTATTACTGTGCGAGA GATATGGACTACTTCGGTATGGACGTCTGGGGCCAAGGGACCACGGTCA CCGTCTCCTCAG |
| 140 413D08-full heavy chain sequence | Amino acid sequence of 413D08 heavy chain | QVQLVESGGGVVQPGRSLRLSCAASGFTFRIYGMHWVRQAPGKGLEWVA VIWYDGSNKYYADSVKGRFTISRDNSDNTLYLQMNSLRAEDTAVYYCAR DMDYFGMDVWGQGTTVTVSSASTKGPSVFPLAPSSKSTSGGTAALGCLV KDYFPEPVTVSWNSGALTSGVHTFPAVLQSSGLYSLSSVVTVPSSSLGT QTYICNVNHKPSNTKVDKKVEPKSCDKTHTCPPCPAPELLGGPSVFLFP PKPKDTLMISRTPEVTCVVVDVSHEDPEVKFNWYVDGVEVHNAKTKPRE EQYNSTYRVVSVLTVLHQDWLNGKEYKCKVSNKALPAPIEKTISKAKGQ PREPQVYTLPPSRDELTKNQVSLTCLVKGFYPSDIAVEWESNGQPENNY KTTPPVLDSDGSFFLYSKLTVDKSRWQQGNVFSCSVMHEALHNHYTQKS LSLSPGK |
| 141 413D08-full heavy chain sequence | Nucleic acid sequence of 413D08 heavy chain | CAGGTGCAGCTGGTGGAGTCTGGGGGAGGCGTGGTCCAGCCTGGGAGGT CCCTGAGACTCTCCTGTGCAGCGTCTGGATTCACCTTCCGTATTTATGG CATGCACTGGGTCCGCCAGGCTCCAGGCAAGGGGCTGGAGTGGGTGGCA GTTATATGGTATGATGGAAGTAATAAATACTATGCTGACTCCGTGAAGG GCCGATTCACCATCTCCAGAGACAATTCCGACAACACGCTGTATCTGCA AATGAACAGCCTGAGAGCCGAGGACACGGCTGTGTATTACTGTGCGAGA GATATGGACTACTTCGGTATGGACGTCTGGGGCCAAGGGACCACGGTCA CCGTCTCCTCAGCCAGCACCAAGGGCCCCTCTGTGTTCCCTCTGGCCCC TTCCAGCAAGTCCACCTCTGGCGGAACAGCCGCTCTGGGCTGCCTCGTG AAGGACTACTTCCCCGAGCCTGTGACCGTGTCCTGGAACTCTGGCGCTC TGACCAGCGGAGTGCACACCTTCCCTGCTGTGCTGCAGTCCTCCGGCCT GTACTCCCTGTCCTCCGTCGTGACCGTGCCTTCCAGCTCTCTGGGCACC CAGACCTACATCTGCAACGTGAACCACAAGCCCTCCAACACCAAGGTGG ACAAGAAGGTGGAACCCAAGTCCTGCGACAAGACCCACACCTGTCCCCC TTGTCCTGCCCCTGAACTGCTGGGCGGACCTTCCGTGTTCCTGTTCCCC CCAAAGCCCAAGGACACCCTGATGATCTCCCGGACCCCCGAAGTGACCT GCGTGGTGGTGGATGTGTCCCACGAGGACCCTGAAGTGAAGTTCAATTG GTACGTGGACGGCGTGGAAGTGCACAACGCCAAGACCAAGCCTAGAGAG GAACAGTACAACTCCACCTACCGGGTGGTGTCCGTGCTGACCGTGCTGC ACCAGGATTGGCTGAACGGCAAAGAGTACAAGTGCAAGGTGTCCAACAA GGCCCTGCCTGCCCCCATCGAAAAGACCATCTCCAAGGCCAAGGGCCAG CCCCGGGAACCCCAGGTGTACACACTGCCCCCTAGCAGGGACGAGCTGA CCAAGAACCAGGTGTCCCTGACCTGTCTCGTGAAAGGCTTCTACCCCTC CGATATCGCCGTGGAATGGGAGTCCAACGGCCAGCCTGAGAACAACTAC |

TABLE S1 -continued

SEQ ID NOS: 1-342

| SEQ ID NO:Name | Description | Sequence |
|---|---|---|
| | | AAGACCACCCCCCCTGTGCTGGACTCCGACGGCTCATTCTTCCTGTACA GCAAGCTGACAGTGGACAAGTCCCGGTGGCAGCAGGGCAACGTGTTCTC CTGCTCCGTGATGCACGAGGCCCTGCACAACCACTACACCCAGAAGTCC CTGTCCCTGAGCCCCGGCAAG |
| 142 413D08-CDRL1 (IMGT) | Amino acid sequence of CDRL1 of 413D08 using IMGT | QGIRND |
| 143 413D08-CDRL2 (IMGT) | Amino acid sequence of CDRL2 of 413D08 using IMGT | AAS |
| 144 413D08-CDRL3 (IMGT) | Amino acid sequence of CDRL3 of 413D08 using IMGT | LQHNSYPRT |
| 145 413D08-CDRL1 (Kabat) | Amino acid sequence of CDRL1 of 413D08 using Kabat | RASQGIRNDLG |
| 146 413D08-CDRL2 (Kabat) | Amino acid sequence of CDRL2 of 413D08 using Kabat | AASSLQS |
| 147 413D08-CDRL3 (Kabat) | Amino acid sequence of CDRL3 of 413D08 using Kabat | LQHNSYPRT |
| 148 413D08-Light chain variable region | Amino acid sequence of $V_L$ of 413D08 | DLQMTQSPSSLSASVGDRVTITCRASQGIRNDLGWYQQKPGKAPKRLIY AASSLQSGVPSRFSGSGSGTEFTLTISSLQPEDFATYYCLQHNSYPRTF GQGTKVEIK |
| 149 413D08-Light chain variable region | Nucleic acid sequence of $V_L$ of 413D08 | GACCTCCAGATGACCCAGTCTCCATCCTCCCTGTCTGCATCTGTAGGAG ACAGAGTCACCATCACTTGCCGGGCAAGTCAGGGCATTAGAAATGATTT AGGCTGGTATCAGCAGAAACCAGGGAAAGCCCCTAAGCGCCTGATCTAT GCTGCATCCAGTTTGCAAAGTGGGGTCCCATCAAGGTTCAGCGGCAGTG GATCTGGGACAGAATTCACTCTCACAATCAGCAGCCTGCAGCCTGAAGA TTTTGCAACTTATTACTGTCTACAGCATAATAGTTACCCTCGGACGTTC GGCCAAGGGACCAAGGTGGAAATCAAAC |
| 150 413D08-full light chain sequence | Amino acid sequence of 413D08 light chain | DLQMTQSPSSLSASVGDRVTITCRASQGIRNDLGWYQQKPGKAPKRLIY AASSLQSGVPSRFSGSGSGTEFTLTISSLQPEDFATYYCLQHNSYPRTF GQGTKVEIKRTVAAPSVFIFPPSDEQLKSGTASVVCLLNNFYPREAKVQ WKVDNALQSGNSQESVTEQDSKDSTYSLSSTLTLSKADYEKHKVYACEV THQGLSSPVTKSFNRGEC |
| 151 413D08-full light chain sequence | Nucleic acid sequence of 413D08 light chain | GACCTCCAGATGACCCAGTCTCCATCCTCCCTGTCTGCATCTGTAGGAG ACAGAGTCACCATCACTTGCCGGGCAAGTCAGGGCATTAGAAATGATTT AGGCTGGTATCAGCAGAAACCAGGGAAAGCCCCTAAGCGCCTGATCTAT GCTGCATCCAGTTTGCAAAGTGGGGTCCCATCAAGGTTCAGCGGCAGTG GATCTGGGACAGAATTCACTCTCACAATCAGCAGCCTGCAGCCTGAAGA TTTTGCAACTTATTACTGTCTACAGCATAATAGTTACCCTCGGACGTTC GGCCAAGGGACCAAGGTGGAAATCAAACGTACGGTGGCCGCTCCCTCCG TGTTCATCTTCCCACCTTCCGACGAGCAGCTGAAGTCCGGCACCGCTTC TGTCGTGTGCCTGCTGAACAACTTCTACCCCCGCGAGGCCAAGGTGCAG TGGAAGGTGGACAACGCCCTGCAGTCCGGCAACTCCCAGGAATCCGTGA CCGAGCAGGACTCCAAGGACAGCACCTACTCCCTGTCCTCCACCCTGAC CCTGTCCAAGGCCGACTACGAGAAGCACAAGGTGTACGCCTGCGAAGTG ACCCACCAGGGCCTGTCTAGCCCCGTGACCAAGTCTTTCAACCGGGGCG AGTGT |
| 152 386H03-CDRH1 (IMGT) | Amino acid sequence of CDRH1 of 386H03 using IMGT | GGSISSSDW |

TABLE S1 -continued

SEQ ID NOS: 1-342

| SEQ ID NO: Name | Description | Sequence |
|---|---|---|
| 153 386H03-CDRH2 (IMGT) | Amino acid sequence of CDRH2 of 386H03 using IMGT | IFHSGNT |
| 154 386H03-CDRH3 (IMGT) | Amino acid sequence of CDRH3 of 386H03 using IMGT | VRDGSGSY |
| 155 386H03-CDRH1 (Kabat) | Amino acid sequence of CDRH1 of 386H03 using Kabat | SSDWWS |
| 156 386H03-CDRH2 (Kabat) | Amino acid sequence of CDRH2 of 386H03 using Kabat | EIFHSGNTNYNPSLKS |
| 157 386H03-CDRH3 (Kabat) | Amino acid sequence of CDRH3 of 386H03 using Kabat | DGSGSY |
| 158 386H03-Heavy chain variable region | Amino acid sequence of $V_H$ of 386H03 | QVQLQESGPGLVKPSGTLSLTCAVSGGSISSSDWWSWVRQPPGKGLEWI GEIFHSGNTNYNPSLKSRVTISVDKSKNQISLRLNSVTAADTAVYYCVR DGSGSYWGQGTLVTVSS |
| 159 386H03-Heavy chain variable region | Nucleic acid sequence of $V_H$ of 386H03 | CAGGTGCAGCTGCAGGAGTCGGGCCCAGGACTGGTGAAGCCTTCGGGGA CCCTGTCCCTCACCTGCGCTGTCTCTGGTGGCTCCATCAGCAGTAGTGA CTGGTGGAGTTGGGTCCGCCAGCCCCCAGGGAAGGGGCTGGAGTGGATT GGGGAAATCTTTCATAGTGGGAACACCAACTACAACCCGTCCCTCAAGA GTCGAGTCACCATATCAGTAGACAAGTCCAAGAACCAGATCTCCCTGAG GCTGAACTCTGTGACCGCCGCGGACACGGCCGTGTATTACTGTGTGAGA GATGGTTCGGGGAGTTACTGGGGCCAGGGAACCCTGGTCACCGTCTCCT CAG |
| 160 386H03-full heavy chain sequence | Amino acid sequence of 386H03 heavy chain | QVQLQESGPGLVKPSGTLSLTCAVSGGSISSSDWWSWVRQPPGKGLEWI GEIFHSGNTNYNPSLKSRVTISVDKSKNQISLRLNSVTAADTAVYYCVR DGSGSYWGQGTLVTVSSASTKGPSVFPLAPSSKSTSGGTAALGCLVKDY FPEPVTVSWNSGALTSGVHTFPAVLQSSGLYSLSSVVTVPSSSLGTQTY ICNVNHKPSNTKVDKKVEPKSCDKTHTCPPCPAPELLGGPSVFLFPPKP KDTLMISRTPEVTCVVVDVSHEDPEVKFNWYVDGVEVHNAKTKPREEQY NSTYRVVSVLTVLHQDWLNGKEYKCKVSNKALPAPIEKTISKAKGQPRE PQVYTLPPSRDELTKNQVSLTCLVKGFYPSDIAVEWESNGQPENNYKTT PPVLDSDGSFFLYSKLTVDKSRWQQGNVFSCSVMHEALHNHYTQKSLSL SPGK |
| 161 386H03-full heavy chain sequence | Nucleic acid sequence of 386H03 heavy chain | CAGGTGCAGCTGCAGGAGTCGGGCCCAGGACTGGTGAAGCCTTCGGGGA CCCTGTCCCTCACCTGCGCTGTCTCTGGTGGCTCCATCAGCAGTAGTGA CTGGTGGAGTTGGGTCCGCCAGCCCCCAGGGAAGGGGCTGGAGTGGATT GGGGAAATCTTTCATAGTGGGAACACCAACTACAACCCGTCCCTCAAGA GTCGAGTCACCATATCAGTAGACAAGTCCAAGAACCAGATCTCCCTGAG GCTGAACTCTGTGACCGCCGCGGACACGGCCGTGTATTACTGTGTGAGA GATGGTTCGGGGAGTTACTGGGGCCAGGGAACCCTGGTCACCGTCTCCT CAGCCAGCACCAAGGGCCCCTCTGTGTTCCCTCTGGCCCCTTCCAGCAA GTCCACCTCTGGCGGAACAGCCGCTCTGGGCTGCCTCGTGAAGGACTAC TTCCCCGAGCCTGTGACCGTGTCGTGGAACTCTGGCGCTCTGACCAGCG GAGTGCACACCTTCCCTGCTGTGCTGCAGTCCTCCGGCCTGTACTCCCT GTCCTCCGTCGTGACCGTGCCTTCCAGCTCTCTGGGCACCCAGACCTAC ATCTGCAACGTGAACCACAAGCCCTCCAACACCAAGGTGGACAAGAAGG TGGAACCCAAGTCCTGCGACAAGACCCACACCTGTCCCCCTTGTCCTGC CCCTGAACTGCTGGGCGGACCTTCCGTGTTCCTGTTCCCCCCAAAGCCC AAGGACACCCTGATGATCTCCCGGACCCCCGAAGTGACCTGCGTGGTGG TGGATGTGTCCCACGAGGACCCTGAAGTGAAGTTCAATTGGTACGTGGA CGGCGTGGAAGTGCACAACGCCAAGACCAAGCCTAGAGAGGAACAGTAC AACTCCACCTACCGGGTGGTGTCCGTGCTGACCGTGCTGCACCAGGATT GGCTGAACGGCAAAGAGTACAAGTGCAAGGTGTCCAACAAGGCCCTGCC TGCCCCCATCGAAAAGACCATCTCCAAGGCCAAGGGCCAGCCCCGGGAA CCCCAGGTGTACACACTGCCCCCTAGCAGGGACGAGCTGACCAAGAACC AGGTGTCCCTGACCTGTCTCGTGAAAGGCTTCTACCCCTCCGATATCGC CGTGGAATGGGAGTCCAACGGCCAGCCTGAGAACAACTACAAGACCACC CCCCCTGTGCTGGACTCCGACGGCTCATTCTTCCTGTACAGCAAGCTGA CAGTGGACAAGTCCCGGTGGCAGCAGGGCAACGTGTTCTCCTGCTCCGT GATGCACGAGGCCCTGCACAACCACTACACCCAGAAGTCCCTGTCCCTG AGCCCCGGCAAG |

TABLE S1 -continued

SEQ ID NOS: 1-342

| SEQ ID NO: | Name | Description | Sequence |
|---|---|---|---|
| 162 | 386H03-CDRL1 (IMGT) | Amino acid sequence of CDRL1 of 386H03 using IMGT | QSVLYSSNNKNY |
| 163 | 386H03-CDRL2 (IMGT) | Amino acid sequence of CDRL2 of 386H03 using IMGT | WAS |
| 164 | 386H03-CDRL3 (IMGT) | Amino acid sequence of CDRL3 of 386H03 using IMGT | QQYYSTRS |
| 165 | 386H03-CDRL1 (Kabat) | Amino acid sequence of CDRL1 of 386H03 using Kabat | KSSQSVLYSSNNKNYLA |
| 166 | 386H03-CDRL2 (Kabat) | Amino acid sequence of CDRL2 of 386H03 using Kabat | WASTRES |
| 167 | 386H03-CDRL3 (Kabat) | Amino acid sequence of CDRL3 of 386H03 using Kabat | QQYYSTRS |
| 168 | 386H03-Light chain variable region | Amino acid sequence of $V_L$ of 386H03 | DIVMTQSPDSLAVSLGERATINCKSSQSVLYSSNNKNYLAWYQQKPGQP PKLLIYWASTRESGVPDRFSGSGSGTDFTLTISSLQAEDVAVYYCQQYY STRSFGQGTKLEIK |
| 169 | 386H03-Light chain variable region | Nucleic acid sequence of $V_L$ of 386H03 | GACATCGTGATGACCCAGTCTCCAGACTCCCTGGCTGTGTCTCTGGGCG AGAGGGCCACCATCAACTGCAAGTCCAGCCAGAGTGTTTTATACAGCTC CAACAATAAGAACTACTTAGCTTGGTACCAGCAGAAACCAGGACAGCCT CCTAAACTGCTCATTTACTGGGCATCTACCCGGGAATCCGGGGTCCCTG ACCGATTCAGTGGCAGCGGGTCTGGGACAGATTTCACTCTCACCATCAG CAGCCTGCAGGCTGAAGATGTGGCAGTTTATTACTGTCAGCAATATTAT AGTACTCGCAGTTTTGGCCAGGGGACCAAGCTGGAGATCAAAC |
| 170 | 386H03-full light chain sequence | Amino acid sequence of 386H03 light chain | DIVMTQSPDSLAVSLGERATINCKSSQSVLYSSNNKNYLAWYQQKPGQP PKLLIYWASTRESGVPDRFSGSGSGTDFTLTISSLQAEDVAVYYCQQYY STRSFGQGTKLEIKRTVAAPSVFIFPPSDEQLKSGTASVVCLLNNFYPR EAKVQWKVDNALQSGNSQESVTEQDSKDSTYSLSSTLTLSKADYEKHKV YACEVTHQGLSSPVTKSFNRGEC |
| 171 | 386H03-full light chain sequence | Nucleic acid sequence of 386H03 light chain | GACATCGTGATGACCCAGTCTCCAGACTCCCTGGCTGTGTCTCTGGGCG AGAGGGCCACCATCAACTGCAAGTCCAGCCAGAGTGTTTTATACAGCTC CAACAATAAGAACTACTTAGCTTGGTACCAGCAGAAACCAGGACAGCCT CCTAAACTGCTCATTTACTGGGCATCTACCCGGGAATCCGGGGTCCCTG ACCGATTCAGTGGCAGCGGGTCTGGGACAGATTTCACTCTCACCATCAG CAGCCTGCAGGCTGAAGATGTGGCAGTTTATTACTGTCAGCAATATTAT AGTACTCGCAGTTTTGGCCAGGGGACCAAGCTGGAGATCAAACGTACGG TGGCCGCTCCCTCCGTGTTCATCTTCCCACCTTCCGACGAGCAGCTGAA GTCCGGCACCGCTTCTGTCGTGTGCCTGCTGAACAACTTCTACCCCCGC GAGGCCAAGGTGCAGTGGAAGGTGGACAACGCCCTGCAGTCCGGCAACT CCCAGGAATCCGTGACCGAGCAGGACTCCAAGGACAGCACCTACTCCCT GTCCTCCACCCTGACCCTGTCCAAGGCCGACTACGAGAAGCACAAGGTG TACGCCTGCGAAGTGACCCACCAGGGCCTGTCTAGCCCCGTGACCAAGT CTTTCAACCGGGGCGAGTGT |
| 172 | 389A03-CDRH1 (IMGT) | Amino acid sequence of CDRH1 of 389A03 using IMGT | GGSISSSSYY |
| 173 | 389A03-CDRH2 (IMGT) | Amino acid sequence of CDRH2 of 389A03 using IMGT | IYSTGYT |

TABLE S1 -continued

SEQ ID NOS: 1-342

| SEQ ID NO: Name | Description | Sequence |
|---|---|---|
| 174 389A03-CDRH3 (IMGT) | Amino acid sequence of CDRH3 of 389A03 using IMGT | AISTAAGPEYFHR |
| 175 389A03-CDRH1 (Kabat) | Amino acid sequence of CDRH1 of 389A03 using Kabat | SSSYYCG |
| 176 389A03-CDRH2 (Kabat) | Amino acid sequence of CDRH2 of 389A03 using Kabat | SIYSTGYTYYNPSLKS |
| 177 389A03-CDRH3 (Kabat) | Amino acid sequence of CDRH3 of 389A03 using Kabat | STAAGPEYFHR |
| 178 389A03-Heavy chain variable region | Amino acid sequence of $V_H$ of 389A03 | QLQESGPGLVKPSETLSLTCTVSGGSISSSSYYCGWIRQPPGKGLDWIG SIYSTGYTYYNPSLKSRVTISIDTSKNQFSCLILTSVTAADTAVYYCAI STAAGPEYFHRWGQGTLVTVSS |
| 179 389A03-Heavy chain variable region | Nucleic acid sequence of $V_H$ of 389A03 | CAGCTGCAGGAGTCGGGCCCAGGCCTGGTGAAGCCTTCGGAGACCCTGT CCCTCACCTGCACTGTCTCTGGTGGCTCCATCAGCAGTAGTAGTTATTA CTGCGGCTGGATCCGCCAGCCCCTGGGAAGGGGCTGGACTGGATTGGG AGTATCTATTCTACTGGGTACACCTACTACAACCCGTCCCTCAAGAGTC GAGTCACCATTTCCATAGACACGTCCAAGAACCAGTTCTCATGCCTGAT ACTGACCTCTGTGACCGCCGCAGACACGGCTGTGTATTACTGTGCGATA AGTACAGCAGCTGGCCCTGAATACTTCCATCGCTGGGGCCAGGGCACCC TGGTCACCGTCTCCTCAG |
| 180 389A03-full heavy chain sequence | Amino acid sequence of 389A03 heavy chain | QLQESGPGLVKPSETLSLTCTVSGGSISSSSYYCGWIRQPPGKGLDWIG SIYSTGYTYYNPSLKSRVTISIDTSKNQFSCLILTSVTAADTAVYYCAI STAAGPEYFHRWGQGTLVTVSSASTKGPSVFPLAPSSKSTSGGTAALGC LVKDYFPEPVTVSWNSGALTSGVHTFPAVLQSSGLYSLSSVVTVPSSSL GTQTYICNVNHKPSNTKVDKKVEPKSCDKTHTCPPCPAPELLGGPSVFL FPPKPKDTLMISRTPEVTCVVVDVSHEDPEVKFNWYVDGVEVHNAKTKP REEQYNSTYRVVSVLTVLHQDWLNGKEYKCKVSNKALPAPIEKTISKAK GQPREPQVYTLPPSRDELTKNQVSLTCLVKGFYPSDIAVEWESNGQPEN NYKTTPPVLDSDGSFFLYSKLTVDKSRWQQGNVFSCSVMHEALHNHYTQ KSLSLSPGK |
| 181 389A03-full heavy chain sequence | Nucleic acid sequence of 389A03 heavy chain | CAGCTGCAGGAGTCGGGCCCAGGCCTGGTGAAGCCTTCGGAGACCCTGT CCCTCACCTGCACTGTCTCTGGTGGCTCCATCAGCAGTAGTAGTTATTA CTGCGGCTGGATCCGCCAGCCCCTGGGAAGGGGCTGGACTGGATTGGG AGTATCTATTCTACTGGGTACACCTACTACAACCCGTCCCTCAAGAGTC GAGTCACCATTTCCATAGACACGTCCAAGAACCAGTTCTCATGCCTGAT ACTGACCTCTGTGACCGCCGCAGACACGGCTGTGTATTACTGTGCGATA AGTACAGCAGCTGGCCCTGAATACTTCCATCGCTGGGGCCAGGGCACCC TGGTCACCGTCTCCTCAGCCAGCACCAAGGGCCCCTCTGTGTTCCCTCT GGCCCCTTCCAGCAAGTCCACCTCTGGCGGAACAGCCGCTCTGGGCTGC CTCGTGAAGGACTACTTCCCCGAGCCTGTGACCGTGTCCTGGAACTCTG GCGCTCTGACCAGCGGAGTGCACACCTTCCCTGCTGTGCTGCAGTCCTC CGGCCTGTACTCCCTGTCCTCCGTCGTGACCGTGCCTTCCAGCTCTCTG GGCACCCAGACCTACATCTGCAACGTGAACCACAAGCCCTCCAACACCA AGGTGGACAAGAAGGTGGAACCCAAGTCCTGCGACAAGACCCACACCTG TCCCCCTTGTCCTGCCCCTGAACTGCTGGGCGGACCTTCCGTGTTCCTG TTCCCCCCAAAGCCCAAGGACACCCTGATGATCTCCCGGACCCCCGAAG TGACCTGCGTGGTGGTGGATGTGTCCCACGAGGACCCTGAAGTGAAGTT CAATTGGTACGTGGACGGCGTGGAAGTGCACAACGCCAAGACCAAGCCT AGAGAGGAACAGTACAACTCCACCTACCGGGTGGTGTCCGTGCTGACCG TGCTGCACCAGGATTGGCTGAACGGCAAAGAGTACAAGTGCAAGGTGTC CAACAAGGCCCTGCCTGCCCCCATCGAAAAGACCATCTCCAAGGCCAAG GGCCAGCCCCGGGAACCCCAGGTGTACACACTGCCCCCTAGCAGGGACG AGCTGACCAAGAACCAGGTGTCCCTGACCTGTCTCGTGAAAGGCTTCTA CCCCTCCGATATCGCCGTGGAATGGGAGTCCAACGGCCAGCCTGAGAAC AACTACAAGACCACCCCCCCTGTGCTGGACTCCGACGGCTCATTCTTCC TGTACAGCAAGCTGACAGTGGACAAGTCCCGGTGGCAGCAGGGCAACGT GTTCTCCTGCTCCGTGATGCACGAGGCCCTGCACAACCACTACACCCAG AAGTCCCTGTCCCTGAGCCCCGGCAAG |
| 182 389A03-CDRL1 (IMGT) | Amino acid sequence of CDRL1 of 389A03 using IMGT | QSVLYSSNSKNF |

US 9,957,323 B2

TABLE S1 -continued

SEQ ID NOS: 1-342

| SEQ ID NO: | Name | Description | Sequence |
|---|---|---|---|
| 183 | 389A03-CDRL2 (IMGT) | Amino acid sequence of CDRL2 of 389A03 using IMGT | WAS |
| 184 | 389A03-CDRL3 (IMGT) | Amino acid sequence of CDRL3 of 389A03 using IMGT | QQYYSTPRT |
| 185 | 389A03-CDRL1 (Kabat) | Amino acid sequence of CDRL1 of 389A03 using Kabat | KSSQSVLYSSNSKNFLA |
| 186 | 389A03-CDRL2 (Kabat) | Amino acid sequence of CDRL2 of 389A03 using Kabat | WASTRGS |
| 187 | 389A03-CDRL3 (Kabat) | Amino acid sequence of CDRL3 of 389A03 using Kabat | QQYYSTPRT |
| 188 | 389A03-Light chain variable region | Amino acid sequence of $V_L$ of 389A03 | DIVMTQSPDSLAVSLGERATINCKSSQSVLYSSNSKNFLAWYQQKPGQP PKLFIYWASTRGSGVPDRISGSGSGTDFNLTISSLQAEDVAVYYCQQYY STPRTFGQGTKVEIK |
| 189 | 389A03-Light chain variable region | Nucleic acid sequence of $V_L$ of 389A03 | GACATCGTGATGACCCAGTCTCCAGACTCCCTGGCTGTGTCTCTGGGCG AGAGGGCCACCATCAACTGCAAGTCCAGCCAGAGTGTTTTATACAGCTC CAACAGTAAGAACTTCTTAGCTTGGTACCAGCAGAAACCGGGACAGCCT CCTAAGCTGTTCATTTACTGGGCATCTACCCGGGGATCCGGGGTCCCTG ACCGAATCAGTGGCAGCGGGTCTGGGACAGATTTCAATCTCACCATCAG CAGCCTGCAGGCTGAAGATGTGGCAGTTTATTACTGTCAACAATATTAT AGTACTCCTCGGACGTTCGGCCAAGGGACCAAGGTGGAGATCAAAC |
| 190 | 389A03-full light chain sequence | Amino acid sequence of 389A03 light chain | DIVMTQSPDSLAVSLGERATINCKSSQSVLYSSNSKNFLAWYQQKPGQP PKLFIYWASTRGSGVPDRISGSGSGTDFNLTISSLQAEDVAVYYCQQYY STPRTFGQGTKVEIKRTVAAPSVFIFPPSDEQLKSGTASVVCLLNNFYP REAKVQWKVDNALQSGNSQESVTEQDSKDSTYSLSSTLTLSKADYEKHK VYACEVTHQGLSSPVTKSFNRGEC |
| 191 | 389A03-full light chain sequence | Nucleic acid sequence of 389A03 light chain | GACATCGTGATGACCCAGTCTCCAGACTCCCTGGCTGTGTCTCTGGGCG AGAGGGCCACCATCAACTGCAAGTCCAGCCAGAGTGTTTTATACAGCTC CAACAGTAAGAACTTCTTAGCTTGGTACCAGCAGAAACCGGGACAGCCT CCTAAGCTGTTCATTTACTGGGCATCTACCCGGGGATCCGGGGTCCCTG ACCGAATCAGTGGCAGCGGGTCTGGGACAGATTTCAATCTCACCATCAG CAGCCTGCAGGCTGAAGATGTGGCAGTTTATTACTGTCAACAATATTAT AGTACTCCTCGGACGTTCGGCCAAGGGACCAAGGTGGAGATCAAACGTA CGGTGGCCGCTCCCTCCGTGTTCATCTTCCCACCTTCCGACGAGCAGCT GAAGTCCGGCACCGCTTCTGTCGTGTGCCTGCTGAACAACTTCTACCCC CGCGAGGCCAAGGTGCAGTGGAAGGTGGACAACGCCCTGCAGTCCGGCA ACTCCCAGGAATCCGTGACCGAGCAGGACTCCAAGGACAGCACCTACTC CCTGTCCTCCACCCTGACCCTGTCCAAGGCCGACTACGAGAAGCACAAG GTGTACGCCTGCGAAGTGACCCACCAGGGCCTGTCTAGCCCCGTGACCA AGTCTTTCAACCGGGGCGAGTGT |
| 192 | Human IgG4 heavy chain constant region #1 | IGHG*01 & IGHG4*04 Heavy Chain Constant Region Nucleotide Sequence | gcttccaccaagggcccatccgtcttccccctggcgccctgctccagga gcacctccgagagcacagccgccctgggctgcctggtcaaggactactt ccccgaaccggtgacggtgtcgtggaactcaggcgccctgaccagcggc gtgcacacctttccggctgtcctacagtcctcaggactctactccctca gcagcgtggtgaccgtgccctccagcagcttgggcacgaagacctacac ctgcaacgtagatcacaagcccagcaacaccaaggtggacaagagagtt gagtccaaatatggtcccccatgcccatcatgcccagcacctgagttcc tggggggaccatcagtcttcctgttccccccaaaacccaaggacactct catgatctcccggacccctgaggtcacgtgcgtggtggtggacgtgagc caggaagaccccgaggtccagttcaactggtacgtggatggcgtggagg tgcataatgccaagacaaagccgcgggaggagcagttcaacagcacgta ccgtgtggtcagcgtcctcaccgtcctgcaccaggactggctgaacggc aaggagtacaagtgcaaggtctccaacaaaggcctcccgtcctccatcg agaaaaccatctccaaagccaaagggcagccccgagagccacaggtgta caccctgcccccatcccaggaggagatgaccaagaaccaggtcagcctg acctgcctggtcaaaggcttctaccccagcgacatcgccgtggagtggg agagcaatgggcagccggagaacaactacaagaccacgcctcccgtgct ggactccgacggctccttcttcctctacagcaggctaaccgtggacaag |

TABLE S1 -continued

SEQ ID NOS: 1-342

| SEQ ID NO: Name | Description | | Sequence |
|---|---|---|---|
| | | | agcaggtggcaggaggggaatgtcttctcatggctccgtgatgcatgagg
ctctgcacaaccactacacacagaagagcctctccctgtctctgggtaa
a |
| 193 | | Heavy Chain Constant Region Amino Acid Sequence | ASTKGPSVFPLAPCSRSTSESTAALGCLVKDYFPEPVTVSWNSGALTSG
VHTFPAVLQSSGLYSLSSVVTVPSSSLGTKTYTCNVDHKPSNTKVDKRV
ESKYGPPCPSCPAPEFLGGPSVFLFPPKPKDTLMISRTPEVTCVVVDVS
QEDPEVQFNWYVDGVEVHNAKTKPREEQFNSTYRVVSVLTVLHQDWLNG
KEYKCKVSNKGLPSSIEKTISKAKGQPREPQVYTLPPSQEEMTKNQVSL
TCLVKGFYPSDIAVEWESNGQPENNYKTTPPVLDSDGSFFLYSRLTVDK
SRWQEGNVFSCSVMHEALHNHYTQKSLSLSLGK |
| 194 Human IgG4 heavy chain constant region #2 | IGHG*02 | Heavy Chain Constant Region Nucleotide Sequence | gcttccaccaagggcccatccgtcttccccctggcgccctgctccagga
gcacctccgagagcacagccgccctgggctgcctggtcaaggactactt
ccccgaaccggtgacggtgtcgtggaactcaggcgccctgaccagcggc
gtgcacaccttcccggctgtcctacagtcctcaggactctactccctca
gcagcgtggtgaccgtgcctccagcagcttgggcacgaagacctacac
ctgcaacgtagatcacaagcccagcaacaccaaggtggacaagagagtt
gagtccaaatatggtcccccgtgcccatcatgcccagcacctgagttcc
tggggggaccatcagtcttcctgttcccccaaaacccaaggacactct
catgatctcccggacccctgaggtcacgtgcgtggtggtggacgtgagc
caggaagaccccgaggtccagttcaactggtacgtggatggcgtggagg
tgcataatgccaagacaaagccgcgggaggagcagttcaacagcacgta
ccgtgtggtcagcgtcctcaccgtcgtgcaccaggactggctgaacggc
aaggagtacaagtgcaaggtctccaacaaaggcctcccgtcctccatcg
agaaaaccatctccaaagccaaagggcagccccgagagccacaggtgta
caccctgcccccatcccaggaggagatgaccaagaaccaggtcagcctg
acctgcctggtcaaaggcttctaccccagcgacatcgccgtggagtggg
agagcaatgggcagccggagaacaactacaagaccacgcctcccgtgct
ggactccgacggctccttcttcctctacagcaggctaaccgtggacaag
agcaggtggcaggaggggaatgtcttctcatgctccgtgatgcatgagg
ctctgcacaaccactacacgcagaagagcctctccctgtctctgggtaa
a |
| 195 | | Heavy Chain Constant Region Amino Acid Sequence | ASTKGPSVFPLAPCSRSTSESTAALGCLVKDYFPEPVTVSWNSGALTSG
VHTFPAVLQSSGLYSLSSVVTVPSSSLGTKTYTCNVDHKPSNTKVDKRV
ESKYGPPCPSCPAPEFLGGPSVFLFPPKPKDTLMISRTPEVTCVVVDVS
QEDPEVQFNWYVDGVEVHNAKTKPREEQFNSTYRVVSVLTVLHQDWLNG
KEYKCKVSNKGLPSSIEKTISKAKGQPREPQVYTLPPSQEEMTKNQVSL
TCLVKGFYPSDIAVEWESNGQPENNYKTTPPVLDSDGSFFLYSRLTVDK
SRWQEGNVFSCSVMHEALHNHYTQKSLSLSLGK |
| 196 Human IgG4 heavy chain constant region #3 | IGHG*0 3 | Heavy Chain Constant Region Nucleotide Sequence | gcttccaccaagggcccatccgtcttccccctggcgccctgctccagga
gcacctccgagagcacagccgccctgggctgcctggtcaaggactactt
ccccgaaccggtgacggtgtcgtggaactcaggcgccctgaccagcggc
gtgcacaccttcccggctgtcctacagtcctcaggactctactccctca
gcagcgtggtgaccgtgcctccagcagcttgggcacgaagacctacac
ctgcaacgtagatcacaagcccagcaacaccaaggtggacaagagagtt
gagtccaaatatggtcccccgtgcccatcatgcccagcacctgagttcc
tggggggaccatcagtcttcctgttcccccaaaacccaaggacactct
catgatctcccggacccctgaggtcacgtgcgtggtggtggacgtgagc
caggaagaccccgaggtccagttcaactggtacgtggatggcgtggagg
tgcataatgccaagacaaagccgcgggaggagcagttcaacagcacgta
ccgtgtggtcagcgtcctcaccgtcgtgcaccaggactggctgaacggc
aaggagtacaagtgcaaggtctccaacaaaggcctcccgtcctccatcg
agaaaaccatctccaaagccaaagggcagccccgagagccacaggtgta
caccctgcccccatcccaggaggagatgaccaagaaccaggtcagcctg
acctgcctggtcaaaggcttctaccccagcgacatcgccgtggagtggg
agagcaatgggcagccggagaacaactacaagaccacgcctcccgtgct
ggactccgacggctccttcttcctctacagcaagctcaccgtggacaag
agcaggtggcaggaggggaacgtcttctcatgctccgtgatgcatgagg
ctctgcacaaccactacacgcagaagagcctctccctgtctctgggtaa
a |
| 197 | | Heavy Chain Constant Region Amino Acid Sequence | ASTKGPSVFPLAPCSRSTSESTAALGCLVKDYFPEPVTVSWNSGALTSG
VHTFPAVLQSSGLYSLSSVVTVPSSSLGTKTYTCNVDHKPSNTKVDKRV
ESKYGPPCPSCPAPEFLGGPSVFLFPPKPKDTLMISRTPEVTCVVVDVS
QEDPEVQFNWYVDGVEVHNAKTKPREEQFNSTYRVVSVLTVLHQDWLNG
KEYKCKVSNKGLPSSIEKTISKAKGQPREPQVYTLPPSQEEMTKNQVSL
TCLVKGFYPSDIAVEWESNGQPENNYKTTPPVLDSDGSFFLYSKLTVDK
SRWQEGNVFSCSVMHEALHNHYTQKSLSLSLGK |

TABLE S1 -continued

SEQ ID NOS: 1-342

| SEQ ID NO: | Name | Description | | Sequence |
|---|---|---|---|---|
| 198 | IgG4 heavy chain constant region-IgG4-PE | -IgG4-PE | Heavy Chain Constant Region Nucleotide Sequence-Synthetic Version A | gcctccaccaagggcccatccgtcttccccctggcgccctgctccagga gcacctccgagagcacggccgccctgggctgcctggtcaaggactactt ccccgaaccagtgacggtgtcgtggaactcaggcgccctgaccagcggc gtgcacaccttcccggctgtcctacagtcctcaggactctactccctca gcagcgtggtgaccgtgccctccagcagcttgggcacgaagacctacac ctgcaacgtagatcacaagcccagcaacaccaaggtggacaagagagtt gagtccaaatatggtcccccatgcccaccatgcccagcgcctgaatttg agggggggaccatcagtcttcctgttccccccaaaacccaaggacactct catgatctcccggacccctgaggtcacgtgcgtggtggtggacgtgagc caggaagaccccgaggtccagttcaactggtacgtggatggcgtggagg tgcataatgccaagacaaagccgcgggaggagcagttcaacagcacgta ccgtgtggtcagcgtcctcaccgtcctgcaccaggactggctgaacggc aaggagtacaagtgcaaggtctccaacaaaggcctcccgtcatcgatcg agaaaaccatctccaaagccaaagggcagccccgagagccacaggtgta caccctgcccccatcccaggaggagatgaccaagaaccaggtcagcctg acctgcctggtcaaaggcttctaccccagcgacatcgccgtggagtggg agagcaatgggcagccggagaacaactacaagaccacgcctcccgtgct ggactccgacggatccttcttcctctacagcaggctaaccgtggacaag agcaggtggcaggaggggaatgtcttctcatgctccgtgatgcatgagg ctctgcacaaccactacacagaagagcctctccctgtctctgggtaaa |
| 199 | IgG4 heavy chain constant region-IgG4-PE | | Heavy Chain Constant Region Amino Acid Sequence-Encoded by Synthetic Version A, B & C (Two residues that differ from the wild-type sequence are identified in bold) | ASTKGPSVFPLAPCSRSTSESTAALGCLVKDYFPEPVTVSWNSGALTSG VHTFPAVLQSSGLYSLSSVVTVPSSSLGTKTYTCNVDHKPSNTKVDKRV ESKYGPPCPPCPAPEFEGGPSVFLFPPKPKDTLMISRTPEVTCVVVDVS QEDPEVQFNWYVDGVEVHNAKTKPREEQFNSTYRVVSVLTVLHQDWLNG KEYKCKVSNKGLPSSIEKTISKAKGQPREPQVYTLPPSQEEMTKNQVSL TCLVKGFYPSDIAVEWESNGQPENNYKTTPPVLDSDGSFFLYSRLTVDK SRWQEGNVFSCSVMHEALHNHYTQKSLSLSLGK |
| 200 | IgG4 heavy chain constant region-IgG4-PE | | Heavy Chain Constant Region Nucleotide Sequence-Synthetic Version B | Gcctccaccaagggacctagcgtgttccctctcgcccctgttccaggt ccacaagcgagtccaccgctgcctcggctgtctggtgaaagactactt tcccgagcccgtgaccgtctcctggaatagcggagccctgacctccggc gtgcacacatttcccgccgtgctgcagagcagcggactgtatagcctga gcagcgtggtgaccgtgcccagctccagcctcggcaccaaaacctacac ctgcaacgtggaccacaagccctccaacaccaaggtggacaagagcgggtg gagagcaagtacggcccccccttgccctccttgtcctgcccctgagttcg agggaggaccctcgcgtgttcctgtttccccccaaacccaaggacaccct gatgatctcccggacccccgaggtgacctgtgtggtcgtggacgtcagc caggaggaccccgaggtgcagttcaactggtatgtggacggcgtggagg tgcacaatgccaaaaccaagcccagggaggagcagttcaattccaccta cagggtggtgagcgtgctgaccgtcctgcatcaggattggctgaacggc aaggagtacaagtgcaaggtgtccaacaagggactgcccagctccatcg agaagaccatcagcaaggctaagggccagccgagggagcccaggtgta tacccctgcctcctagccaggaagagatgaccaagaaccaagtgtcctg acctgcctggtgaagggattctacccctccgacatcgccgtggagtggg agagcaatggccagcccgagaacaactacaaaacaaccctcccgtgct cgatagcgacggcagcttctttctctacagccggctgacagtggacaag agcaggtggcaggaggcaacgtgttctcctgttccgtgatgcacgagg ccctgcacaatcactacacccagaagagcctctccctgtccctgggcaa g |
| 201 | IgG4 heavy chain constant region-IgG4-PE | | Heavy Chain Constant Region Nucleotide Sequence-Synthetic Version C | gccagcaccaagggcccttccgtgttccccctggccccttgcagcagga gcacctccgaatccacagctgcctcggctgtctggtgaaggactactt tcccgagcccgtgaccgtgagctggaacagcggcgctctgacatccggc gtccacacctttcctgccgtcctgcagtcctccggcctctactccctgt cctccgtggtgaccgtgcctagctcctccctcggcaccaagacctacac ctgtaacgtggaccacaaacccctccaacaccaaggtggacaaacgggtc gagagcaagtacggcccctcctgccctccttgtcctgccccgagttcg aaggcggaccccagcgtgttcctgttccctcctaagccccaaggacaccct catgatcagccggacacccgaggtgacctgcgtggtggtggatgtgagc caggaggacctgaggtccagttcaactggtatgtggatggcgtggagg tgcacaacgccaagacaaagccgggaagagcagttcaactccaccta cagggtggtcagcgtgctgaccgtgctgcatcaggactggctgaacggc aaggagtacaagtgcaaggtcagcaataagggactgcccagcagcatcg agaagaccatctccaaggctaaggccagcccgggaacctcaggtgta caccctgcctcccagccaggaggagatgaccaagaaccaggtgagcctg |

TABLE S1 -continued

SEQ ID NOS: 1-342

| SEQ ID NO: | Name | Description | | Sequence |
|---|---|---|---|---|
| | | | | acctgcctggtgaagggattctacccttccgacatcgccgtggagtggg agtccaacggccagcccgagaacaattataagaccacccctcccgtcct cgacagcgacggatccttctttctgtactccaggctgaccgtggataag tccaggtggcaggaaggcaacgtgttcagctgctccgtgatgcacgagg ccctgcacaatcactacacccagaagtccctgagcctgtccctgggaaa g |
| 202 | IgG4 heavy chain constant region | | Heavy Chain Constant Region Nucleotide Sequence- Synthetic Version D | gcctccaccaagggcccatccgtcttccccctggcgccctgctccagga gcacctccgagagcacggcgccctgggctgcctggtcaaggactactt ccccgaaccagtgacggtgtcgtggaactcaggcgccctgaccagcggc gtgcacaccttcccggctgtcctacagtcctcaggactctactccctca gcagcgtggtgaccgtgccctccagcagcttgggcacgaagacctacac ctgcaacgtagatcacaagcccagcaacaccaaggtggacaagagagtt gagtccaaatatggtcccccatgcccaccatgcccagcgcctccagttg cggggggaccatcagtcttcctgttccccccaaaacccaaggacactct catgatctcccggacccctgaggtcacgtgcgtggtggtggacgtgagc caggaagaccccgaggtccagttcaactggtacgtggatggcgtggagg tgcataatgccaagacaaagccgcgggaggagcagttcaacagcacgta ccgtgtggtcagcgtcctcaccgtcctgcaccaggactggctgaacggc aaggagtacaagtgcaaggtctccaacaaagcccctgcgtcatcgatcg agaaaaccatctccaaagccaaagggcagccccgagagccacaggtgta caccctgcccccatcccaggaggagatgaccaagaaccaggtcagcctg acctgcctggtcaaaggcttctaccccagcgacatcgccgtggagtggg agagcaatgggcagccggagaacaactacaagaccacgcctcccgtgct ggactccgacggatccttcttcctctacagcaggctaaccgtggacaag agcaggtggcaggaggggaatgtcttctcatgctccgtgatgcatgagg ctctgcacaaccactacacacagaagagcctctccctgtctctgggtaa a |
| 203 | | | Heavy Chain Constant Region Amino Acid Sequence- encoded by Synthetic Version D | ASTKGPSVFPLAPCSRSTSESTAALGCLVKDYFPEPVTVSWNSGALTSG VHTFPAVLQSSGLYSLSSVVTVPSSSLGTKTYTCNVDHKPSNTKVDKRV ESKYGPPCPPCPAPPVAGGPSVFLFPPKPKDTLMISRTPEVTCVVVDVS QEDPEVQFNWYVDGVEVHNAKTKPREEQFNSTYRVVSVLTVLHQDWLNG KEYKCKVSNKGLPSSIEKTISKAKGQPREPQVYTLPPSQEEMTKNQVSL TCLVKGFYPSDIAVEWESNGQPENNYKTTPPVLDSDGSFFLYSRLTVDK SRWQEGNVFSCSVMHEALHNHYTQKSLSLSLGK |
| 204 | Disabled Human IgG1 heavy chain constant region | Disabled IGHG1 | Heavy Chain Constant Region Nucleotide Sequence | gcctccaccaagggcccatcggtcttccccctggcaccctcctccaaga gcacctctgggggcacagcggccctgggctgcctggtcaaggactactt ccccgaaccggtgacggtgtcgtggaactcaggcgccctgaccagcggc gtgcacaccttcccggctgtcctacagtcctcaggactctactccctca gcagcgtggtgaccgtgccctccagcagcttgggcacccagacctacat ctgcaacgtgaatcacaagcccagcaacaccaaggtggacaagaaagtt gagcccaaatcttgtgacaaaactcacacatgcccaccgtgcccagcac ctgaactcgcggggcaccgtcagtcttcctcttccccccaaaacccaa ggacaccctcatgatctcccggacccctgaggtcacatgcgtggtggtg gacgtgagccacgaagaccctgaggtcaagttcaactggtacgtggacg gcgtggaggtgcataatgccaagacaaagccgcgggaggagcagtacaa cagcacgtaccgtgtggtcagcgtcctcaccgtcctgcaccaggactgg ctgaatggcaaggagtacaagtgcaaggtctccaacaaagcccctccag cccccatcgagaaaaccatctccaaagccaaagggcagccccgagaacc acaggtgtacaccctgcccccatcccgggatgagctgaccaagaaccag gtcagcctgacctgcctggtcaaaggcttctatcccagcgacatcgccg tggagtgggagagcaatgggcagccggagaacaactacaagaccacgcc tcccgtgctggactccgacggctccttcttcctctacagcaagctcacc gtggacaagagcaggtggcagcaggggaacgtcttctcatgctccgtga tgcatgaggctctgcacaaccactacacgcagaagagcctctccctgtc tccgggtaaa |
| 205 | | | Heavy Chain Constant Region Amino Acid Sequence (Two residues that differ from the wild-type sequence are identified in bold) | ASTKGPSVFPLAPSSKSTSGGTAALGCLVKDYFPEPVTVSWNSGALTSG VHTFPAVLQSSGLYSLSSVVTVPSSSLGTQTYICNVNHKPSNTKVDKKV EPKSCDKTHTCPPCPAPELAGAPSVFLFPPKPKDTLMISRTPEVTCVVV DVSHEDPEVKFNWYVDGVEVHNAKTKPREEQYNSTYRVVSVLTVLHQDW LNGKEYKCKVSNKALPAPIEKTISKAKGQPREPQVYTLPPSRDELTKNQ VSLTCLVKGFYPSDIAVEWESNGQPENNYKTTPPVLDSDGSFFLYSKLT VDKSRWQQGNVFSCSVMHEALHNHYTQKSLSLSPGK |

TABLE S1 -continued

SEQ ID NOS: 1-342

| SEQ ID NO: | Name | Description | | Sequence |
|---|---|---|---|---|
| 206 | Human Cκ constant region | IGKC*01 | Cκ Light Chain Constant Region Nucleotide Sequence | cgtacggtggccgctccctccgtgttcatcttcccaccttccgacgagc agctgaagtccggcaccgcttctgtcgtgtgcctgctgaacaacttcta cccccgcgaggccaaggtgcagtggaaggtggacaacgccctgcagtcc ggcaactcccaggaatccgtgaccgagcaggactccaaggacagcacct actccctgtcctccaccctgaccctgtccaaggccgactacgagaagca caaggtgtacgcctgcgaagtgacccaccagggcctgtctagcccgtg accaagtctttcaaccggggcgagtgt |
| 207 | | | Cκ Light Chain Constant Region Amino Acid Sequence | RTVAAPSVFIFPPSDEQLKSGTASVVCLLNNFYPREAKVQWKVDNALQS GNSQESVTEQDSKDSTYSLSSTLTLSKADYEKHKVYACEVTHQGLSSPV TKSFNRGEC |
| 208 | Human Cκ constant region | IGKC*02 | Cκ Light Chain Constant Region Nucleotide Sequence | cgaactgtggctgcaccatctgtcttcatcttcccgccatctgatgagc agttgaaatctggaactgcctctgttgtgtgcctgctgaataacttcta tcccagagaggccaaagtacagtggaaggtggataacgccctccaatcg ggtaactcccaggagagtgtcacagagcaggagagcaaggacagcacct acagcctcagcagcaccctgacgctgagcaaagcagactacgagaaaca caagtctacgccggcgaagtcacccatcagggcctgagctcgcccgtc acaaagagcttcaacaggggagagtgt |
| 209 | | | Cκ Light Chain Constant Region Amino Acid Sequence | RTVAAPSVFIFPPSDEQLKSGTASVVCLLNNFYPREAKVQWKVDNALQS GNSQESVTEQESKDSTYSLSSTLTLSKADYEKHKVYAGEVTHQGLSSPV TKSFNRGEC |
| 210 | Human Cκ constant region | IGKC*03 | Cκ Light Chain Constant Region Nucleotide Sequence | cgaactgtggctgcaccatctgtcttcatcttcccgccatctgatgagc agttgaaatctggaactgcctctgttgtgtgcctgctgaataacttcta tcccagagaggccaaagtacagcggaaggtggataacgccctccaatcg ggtaactcccaggagagtgtcacagagcaggagagcaaggacagcacct acagcctcagcagcaccctgacgctgagcaaagcagactacgagaaaca caagtctacgcctgcgaagtcacccatcagggcctgagctcgcccgtc acaaagagcttcaacaggggagagtgt |
| 211 | | | Cκ Light Chain Constant Region Amino Acid Sequence | RTVAAPSVFIFPPSDEQLKSGTASVVCLLNNFYPREAKVQRKVDNALQS GNSQESVTEQESKDSTYSLSSTLTLSKADYEKHKVYACEVTHQGLSSPV TKSFNRGEC |
| 212 | Human Cκ constant region | IGKC*04 | Cκ Light Chain Constant Region Nucleotide Sequence | cgaactgtggctgcaccatctgtcttcatcttcccgccatctgatgagc agttgaaatctggaactgcctctgttgtgtgcctgctgaataacttcta tcccagagaggccaaagtacagtggaaggtggataacgccctccaatcg ggtaactcccaggagagtgtcacagagcaggacagcaaggacagcacct acagcctcagcagcaccctgacgctgagcaaagcagactacgagaaaca caaactctacgcctgcgaagtcacccatcagggcctgagctcgcccgtc acaaagagcttcaacaggggagagtgt |
| 213 | | | Cκ Light Chain Constant Region Amino Acid Sequence | RTVAAPSVFIFPPSDEQLKSGTASVVCLLNNFYPREAKVQWKVDNALQS GNSQESVTEQDSKDSTYSLSSTLTLSKADYEKHKLYACEVTHQGLSSPV TKSFNRGEC |
| 214 | Human Cκ constant region | IGKC*05 | Cκ Light Chain Constant Region Nucleotide Sequence | cgaactgtggctgcaccatctgtcttcatcttcccgccatctgatgagc agttgaaatctggaactgcctctgttgtgtgcctgctgaataacttcta tcccagagaggccaaagtacagtggaaggtggataacgccctccaatcg ggtaactcccaggagagtgtcacagagcaggacagcaaggacagcacct acagcctcagcaacaccctgacgctgagcaaagcagactacgagaaaca caagtctacgcctgcgaagtcacccatcagggcctgagctcgcccgtc acaaagagcttcaacaggggagagtgc |
| 215 | | | Cκ Light Chain Constant Region Amino Acid Sequence | RTVAAPSVFIFPPSDEQLKSGTASVVCLLNNFYPREAKVQWKVDNALQS GNSQESVTEQDSKDSTYSLSNTLTLSKADYEKHKVYACEVTHQGLSSPV TKSFNRGEC |

TABLE S1 -continued

SEQ ID NOS: 1-342

| SEQ ID NO: | Name | Description | | Sequence |
|---|---|---|---|---|
| 216 | Human Cλ constant region | IGCA1*01 | Cλ Light Chain Constant Region Nucleotide Sequence | cccaaggccaaccccacggtcactctgttcccgccctcctctgaggagc tccaagccaacaaggccacactagtgtgtctgatcagtgacttctaccc gggagctgtgacagtggcttggaaggcagatggcagccccgtcaaggcg ggagtggagacgaccaaaccctccaaacagagcaacaacaagtacgcgg ccagcagctacctgagcctgacgcccgagcagtggaagtcccacagaag ctacagctgccaggtcacgcatgaagggagcaccgtggagaagacagtg gcccctacagaatgttca |
| 217 | | | Cλ Light Chain Constant Region Amino Acid Sequence | PKANPTVTLFPPSSEELQANKATLVCLISDFYPGAVTVAWKADGSPVKA GVETTKPSKQSNNKYAASSYLSLTPEQWKSHRSYSCQVTHEGSTVEKTV APTECS |
| 218 | Human Cλ constant region | IGCA1*02 | Cλ Light Chain Constant Region Nucleotide Sequence | ggtcagcccaaggccaaccccactgtcactctgttcccgccctcctctg aggagctccaagccaacaaggccacactagtgtgtctgatcagtgactt ctacccgggagctgtgacagtggcctggaaggcagatggcagcccccgtc aaggcgggagtggagaccaccaaaccctccaaacagagcaacaacaagt acgcggccagcagctacctgagcctgacgcccgagcagtggaagtccca cagaagctacagctgccaggtcacgcatgaagggagcaccgtggagaag acagtggcccctacagaatgttca |
| 219 | | | Cλ Light Chain Constant Region Amino Acid Sequence | GQPKANPTVTLFPPSSEELQANKATLVCLISDFYPGAVTVAWKADGSPV KAGVETTKPSKQSNNKYAASSYLSLTPEQWKSHRSYSCQVTHEGSTVEK TVAPTECS |
| 220 | Human Cλ constant region | IGCA2*01 | Cλ Light Chain Constant Region Nucleotide Sequence- Version A | ggtcagcccaaggccaaccccactgtcactctgttcccgccctcctctg aggagctccaagccaacaaggccacactagtgtgtctgatcagtgactt ctacccgggagctgtgacagtggcctggaaggcagatggcagcccccgtc aaggcgggagtggagaccaccaaaccctccaaacagagcaacaacaagt acgcggccagcagctacctgagcctgacgcccgagcagtggaagtccca cagaagctacagctgccaggtcacgcatgaagggagcaccgtggagaag acagtggcccctacagaatgttca |
| 221 | | | Cλ Light Chain Constant Region Nucleotide Sequence- Version B | ggccagcctaaggccgctccttctgtgaccctgttccccccatcctccg aggaactgcaggctaacaaggccacccctcgtgtgcctgatcagcgactt ctaccctggcgccgtgaccgtggcctggaaggctgatagctctcctgtg aaggccggcgtggaaaccaccacccttccaagcagtccaacaacaat acgccgcctcctcctacttgtccctgacccctgagcagtggaagtccca ccggtcctacagctgccaagtgacccacgagggctccaccgtggaaaag accgtggctcctaccgagtgctcc |
| 222 | | | Cλ Light Chain Constant Region Nucleotide Sequence- Version C | ggccagcctaaagctgccccagcgtcaccctgtttcctccctccagcg aggagctccaggccaacaaggccaccctcgtgtgcctgatctccgactt ctatcccggcgctgtgaccgtggcttggaaagccgactccagccctgtc aaagccggcgtggagaccaccacaccctccaagcagtccaacaacaagt acgccgcctccagctatctctccctgacccctgagcagtggaagtccca ccggtcctactcctgtcaggtgacccacgagggctccaccgtggaaaag accgtcgcccccaccgagtgctcc |
| 223 | | | Cλ Light Chain Constant Region Amino Acid Sequence- Encoded by Version A, B & C | GQPKANPTVTLFPPSSEELQANKATLVCLISDFYPGAVTVAWKADGSPV KAGVETTKPSKQSNNKYAASSYLSLTPEQWKSHRSYSCQVTHEGSTVEK TVAPTECS |
| 224 | Human Cλ constant region | IGCA2*02 & IGLC2*03 | Cλ Light Chain Constant Region Nucleotide Sequence | ggtcagcccaaggctgccccctcggtcactctgttcccgccctcctctg aggagcttcaagccaacaaggccacactggtgtgtctcataagtgactt ctacccgggagccgtgacagtggcctggaaggcagatagcagcccccgtc aaggcgggagtggagaccaccacaccctccaaacaaagcaacaacaagt acgcggccagcagctatctgagcctgacgcctgagcagtggaagtccca cagaagctacagctgccaggtcacgcatgaagggagcaccgtggagaag acagtggcccctacagaatgttca |
| 225 | | | Cλ Light Chain Constant Region Amino Acid Sequence | GQPKAAPSVTLFPPSSEELQANKATLVCLISDFYPGAVTVAWKADSSPV KAGVETTTPSKQSNNKYAASSYLSLTPEQWKSHRSYSCQVTHEGSTVEK TVAPTECS |

TABLE S1 -continued

SEQ ID NOS: 1-342

| SEQ ID NO: Name | Description | | Sequence |
|---|---|---|---|
| 226 Human Cλ constant region | IGCA3*01 | Cλ Light Chain Constant Region Nucleotide Sequence | cccaaggctgcccctcggtcactctgttcccaccctcctctgaggagc ttcaagccaacaaggccacactggtgtgtctcataagtgacttctaccc gggagccgtgacagttgcctggaaggcagatagcagccccgtcaaggcg ggggtggagaccaccacaccctccaaacaaagcaacaacaagtacgcgg ccagcagctacctgagcctgacgcctgagcagtggaagtcccacaaaag ctacagctgccaggtcacgcatgaagggagcaccgtggagaagacagtt gcccctacggaatgttca |
| 227 | | Cλ Light Chain Constant Region Amino Acid Sequence | PKAAPSVTLFPPSSEELQANKATLVCLISDFYPGAVTVAWKADSSPVKA GVETTTPSKQSNNKYAASSYLSLTPEQWKSHKSYSCQVTHEGSTVEKTV APTECS |
| 228 Human Cλ constant region | IGCA3*02 | Cλ Light Chain Constant Region Nucleotide Sequence | ggtcagcccaaggctgcccctcggtcactctgttcccaccctcctctg aggagcttcaagccaacaaggccacactggtgtgtctcataagtgactt ctaccggggccagtgacagttgcctggaaggcagatagcagccccgtc aaggcgggggtggagaccaccacaccctccaaacaaagcaacaacaagt acgcggccagcagctacctgagcctgacgcctgagcagtggaagtccca caaaagctacagctgccaggtcacgcatgaagggagcaccgtggagaag acagtggcccctacggaatgttca |
| 229 | | Cλ Light Chain Constant Region Amino Acid Sequence | GQPKAAPSVTLFPPSSEELQANKATLVCLISDFYPGPVTVAWKADSSPV KAGVETTTPSKQSNNKYAASSYLSLTPEQWKSHKSYSCQVTHEGSTVEK TVAPTECS |
| 230 Human Cλ constant region | IGCA3*03 | Cλ Light Chain Constant Region Nucleotide Sequence | ggtcagcccaaggctgcccctcggtcactctgttcccaccctcctctg aggagcttcaagccaacaaggccacactggtgtgtctcataagtgactt ctaccggggagccgtgacagtggcctggaaggcagatagcagccccgtc aaggcgggagtggagaccaccacaccctccaaacaaagcaacaacaagt acgcggccagcagctacctgagcctgacgcctgagcagtggaagtccca caaaagctacagctgccaggtcacgcatgaagggagcaccgtggagaag acagtggcccctacagaatgttca |
| 231 | | Cλ Light Chain Constant Region Amino Acid Sequence | GQPKAAPSVTLFPPSSEELQANKATLVCLISDFYPGAVTVAWKADSSPV KAGVETTTPSKQSNNKYAASSYLSLTPEQWKSHKSYSCQVTHEGSTVEK TVAPTECS |
| 232 Human Cλ constant region | IGCA3*04 | Cλ Light Chain Constant Region Nucleotide Sequence | ggtcagcccaaggctgcccctcggtcactctgttcccgccctcctctg aggagcttcaagccaacaaggccacactggtgtgtctcataagtgactt ctaccggggagccgtgacagtggcctggaaggcagatagcagccccgtc aaggcgggagtggagaccaccacaccctccaaacaaagcaacaacaagt acgcggccagcagctacctgagcctgacgcctgagcagtggaagtccca cagaagctacagctgccaggtcacgcatgaagggagcaccgtggagaag acagtggcccctacagaatgttca |
| 233 | | Cλ Light Chain Constant Region Amino Acid Sequence | GQPKAAPSVTLFPPSSEELQANKATLVCLISDFYPGAVTVAWKADSSPV KAGVETTTPSKQSNNKYAASSYLSLTPEQWKSHRSYSCQVTHEGSTVEK TVAPTECS |
| 234 Human Cλ constant region | IGCA6*01 | Cλ Light Chain Constant Region Nucleotide Sequence | ggtcagcccaaggctgccccatcggtcactctgttcccgccctcctctg aggagcttcaagccaacaaggccacactggtgtgcctgatcagtgactt ctaccggggagctgtgaaagtggcctggaaggcagatggcagccccgtc aacacgggagtggagaccaccacaccctccaaacagagcaacaacaagt acgcggccagcagctacctgagcctgacgcctgagcagtggaagtccca cagaagctacagctgccaggtcacgcatgaagggagcaccgtggagaag acagtggcccctgcagaatgttca |
| 235 | | Cλ Light Chain Constant Region Amino Acid Sequence | GQPKAAPSVTLFPPSSEELQANKATLVCLISDFYPGAVKVAWKADGSPV NTGVETTTPSKQSNNKYAASSYLSLTPEQWKSHRSYSCQVTHEGSTVEK TVAPAECS |

TABLE S1 -continued

SEQ ID NOS: 1-342

| SEQ ID NO: | Name | Description | Sequence |
|---|---|---|---|
| 236 | Human Cλ constant region | IGLC7*01 & IGCA7*02 Cλ Light Chain Constant Region Nucleotide Sequence | ggtcagcccaaggctgccccatcggtcactctgttcccaccctcctctg aggagcttcaagccaacaaggccacactggtgtgtctcgtaagtgactt ctacccgggagcctgacagtggcctggaaggcagatggcagcccccgtc aaggtgggagtggagaccaccaaaccctccaaacaaagcaacaacaagt atgcggccagcagctacctgagcctgacgcccgagcagtggaagtccca cagaaagctacagctgccgggtcacgcatgaagggagcaccgtggagaag acagtggcccctgcagaatgctct |
| 237 | | Cλ Light Chain Constant Region Amino Acid Sequence | GQPKAAPSVTLFPPSSEELQANKATLVCLVSDFYPGAVTVAWKADGSPV KVGVETTKPSKQSNNKYAASSYLSLTPEQWKSHRSYSCRVTHEGSTVEK TVAPAECS |
| 238 | 413G05-CDRH1 (IMGT) | Amino acid sequence of CDRH1 of 413G05 using IMGT | GFTFSDYY |
| 239 | 413G05-CDRH2 (IMGT) | Amino acid sequence of CDRH2 of 413G05 using IMGT | ISTSGSTI |
| 240 | 413G05-CDRH3 (IMGT) | Amino acid sequence of CDRH3 of 413G05 using IMGT | ARGITGTNFYHYGLGV |
| 241 | 413G05-CDRH1 (Kabat) | Amino acid sequence of CDRH1 of 413G05 using Kabat | DYYMS |
| 242 | 413G05-CDRH2 (Kabat) | Amino acid sequence of CDRH2 of 413G05 using Kabat | YISTSGSTIYYADSVKG |
| 243 | 413G05-CDRH3 (Kabat) | Amino acid sequence of CDRH3 of 413G05 using Kabat | GITGTNFYHYGLGV |
| 244 | 413G05-Heavy chain variable region | Amino acid sequence of $V_H$ of 413G05 | QVQLVESGGGLVKPGGSLRLSCAASGFTFSDYYMSWIRQVPGKGLEWVS YISTSGSTIYYADSVKGRFTISRDNAKNSLYLQMNSLRAEDAAVYHCAR GITGTNFYHYGLGVWGQGTTVTVSS |
| 245 | 413G05-Heavy chain variable region | Nucleic acid sequence of $V_H$ of 413G05 | CAGGTGCAGCTGGTGGAGTCTGGGGGAGGCTTGGTCAAGCCTGGAGGGT CCCTGAGACTCTCCTGTGCAGCCTCTGGATTCACCTTCAGTGACTACTA CATGAGCTGGATCCGCCAGGTTCCAGGGAAGGGGCTGGAGTGGGTTTCA TACATTAGTACTAGTGGTAGTACCATATACTACGCAGACTCTGTGAAGG GCCGATTCACCATCTCCAGGGACAACGCCAAGAACTCACTGTATCTACA AATGAACAGCCTGAGAGCCGAGGACGCGGCCGTGTATCACTGTGCGAGA GGTATAACTGGAACTAACTTCTACCACTACGGTTTGGGCGTCTGGGGCC AAGGGACCACGGTCACCGTCTCCTCAG |
| 246 | 413G05-full heavy chain sequence | Amino acid sequence of 413G05 heavy chain | QVQLVESGGGLVKPGGSLRLSCAASGFTFSDYYMSWIRQVPGKGLEWVS YISTSGSTIYYADSVKGRFTISRDNAKNSLYLQMNSLRAEDAAVYHCAR GITGTNFYHYGLGVWGQGTTVTVSSASTKGPSVFPLAPSSKSTSGGTAA LGCLVKDYFPEPVTVSWNSGALTSGVHTFPAVLQSSGLYSLSSVVTVPS SSLGTQTYICNVNHKPSNTKVDKKVEPKSCDKTHTCPPCPAPELLGGPS VFLFPPKPKDTLMISRTPEVTCVVVDVSHEDPEVKFNWYVDGVEVHNAK TKPREEQYNSTYRVVSVLTVLHQDWLNGKEYKCKVSNKALPAPIEKTIS KAKGQPREPQVYTLPPSRDELTKNQVSLTCLVKGFYPSDIAVEWESNGQ PENNYKTTPPVLDSDGSFFLYSKLTVDKSRWQQGNVFSCSVMHEALHNH YTQKSLSLSPGK |
| 247 | 413G05-full heavy chain sequence | Nucleic acid sequence of 413G05 heavy chain | CAGGTGCAGCTGGTGGAGTCTGGGGGAGGCTTGGTCAAGCCTGGAGGGT CCCTGAGACTCTCCTGTGCAGCCTCTGGATTCACCTTCAGTGACTACTA CATGAGCTGGATCCGCCAGGTTCCAGGGAAGGGGCTGGAGTGGGTTTCA TACATTAGTACTAGTGGTAGTACCATATACTACGCAGACTCTGTGAAGG GCCGATTCACCATCTCCAGGGACAACGCCAAGAACTCACTGTATCTACA AATGAACAGCCTGAGAGCCGAGGACGCGGCCGTGTATCACTGTGCGAGA GGTATAACTGGAACTAACTTCTACCACTACGGTTTGGGCGTCTGGGGCC AAGGGACCACGGTCACCGTCTCCTCAGCCAGCACCAAGGGCCCCTCTGT GTTCCCTCTGGCCCCTTCCAGCAAGTCCACCTCTGGCGGAACAGCCGCT CTGGGCTGCCTCGTGAAGGACTACTTCCCCGAGCCTGTGACCGTGTCCT |

| SEQ ID NO:Name | Description | Sequence |
|---|---|---|
| | | GGAACTCTGGCGCTCTGACCAGCGGAGTGCACACCTTCCCTGCTGTGCT GCAGTCCTCCGGCCTGTACTCCCTGTCCTCCGTCGTGACCGTGCCTTCC AGCTCTCTGGGCACCCAGACCTACATCTGCAACGTGAACCACAAGCCCT CCAACACCAAGGTGGACAAGAAGGTGGAACCCAAGTCCTGCGACAAGAC CCACACCTGTCCCCCTTGTCCTGCCCCTGAACTGCTGGGCGGACCTTCC GTGTTCCTGTTCCCCCCAAAGCCCAAGGACACCCTGATGATCTCCCGGA CCCCCGAAGTGACCTGCGTGGTGGTGGATGTGTCCCACGAGGACCCTGA AGTGAAGTTCAATTGGTACGTGGACGGCGTGGAAGTGCACAACGCCAAG ACCAAGCCTAGAGAGGAACAGTACAACTCCACCTACCGGGTGGTGTCCG TGCTGACCGTGCTGCACCAGGATTGGCTGAACGGCAAAGAGTACAAGTG CAAGGTGTCCAACAAGGCCCTGCCTGCCCCCATCGAAAAGACCATCTCC AAGGCCAAGGGCCAGCCCCGGGAACCCCAGGTGTACACACTGCCCCCTA GCAGGGACGAGCTGACCAAGAACCAGGTGTCCCTGACCTGTCTCGTGAA AGGCTTCTACCCCTCCGATATCGCCGTGGAATGGGAGTCCAACGGCCAG CCTGAGAACAACTACAAGACCACCCCCCCTGTGCTGGACTCCGACGGCT CATTCTTCCTGTACAGCAAGCTGACAGTGGACAAGTCCCGGTGGCAGCA GGGCAACGTGTTCTCCTGCTCCGTGATGCACGAGGCCCTGCACAACCAC TACACCCAGAAGTCCCTGTCCCTGAGCCCCGGCAAG |
| 248 413G05-CDRL1 (IMGT) | Amino acid sequence of CDRL1 of 413G05 using IMGT | QGINSW |
| 249 413G05-CDRL2 (IMGT) | Amino acid sequence of CDRL2 of 413G05 using IMGT | AAS |
| 250 413G05-CDRL3 (IMGT) | Amino acid sequence of CDRL3 of 413G05 using IMGT | QQVNSFPLT |
| 251 413G05-CDRL1 (Kabat) | Amino acid sequence of CDRL1 of 413G05 using Kabat | RASQGINSWLA |
| 252 413G05-CDRL2 (Kabat) | Amino acid sequence of CDRL2 of 413G05 using Kabat | AASTLQS |
| 253 413G05-CDRL3 (Kabat) | Amino acid sequence of CDRL3 of 413G05 using Kabat | QQVNSFPLT |
| 254 413G05-Light chain variable region | Amino acid sequence of $V_L$ of 413G05 | DIQMTQSPSSVSASVGDRVTITCRASQGINSWLAWYQQKPGKAPKLLIY AASTLQSGVPSRFSGSGSGADFTLTISSLQPEDFATYYCQQVNSFPLTF GGGTKVEIK |
| 255 413G05-Light chain variable region | Nucleic acid sequence of $V_L$ of 413G05 | GACATCCAGATGACCCAGTCTCCATCTTCCGTGTCTGCATCTGTAGGAG ACAGAGTCACCATCACTTGTCGGGCGAGTCAGGGTATTAACAGCTGGTT AGCCTGGTATCAGCAGAAACCAGGGAAAGCCCCTAAGCTCCTGATCTAT GCTGCATCCACTTTGCAAAGTGGGGTCCCATCAAGGTTCAGCGGCAGTG GGTCTGGGGCAGATTTCACTCTCACCATCAGCAGCCTGCAGCCTGAAGA TTTTGCAACTTACTATTGTCAACAGGTTAACAGTTTCCCGCTCACTTTC GGCGGAGGGACCAAGGTGGAGATCAAAC |
| 256 413G05-full light chain sequence | Amino acid sequence of 413G05 chain | DIQMTQSPSSVSASVGDRVTITCRASQGINSWLAWYQQKPGKAPKLLIY AASTLQSGVPSRFSGSGSGADFTLTISSLQPEDFATYYCQQVNSFPLTF GGGTKVEIKRTVAAPSVFIFPPSDEQLKSGTASVVCLLNNFYPREAKVQ WKVDNALQSGNSQESVTEQDSKDSTYSLSSTLTLSKADYEKHKVYACEV THQGLSSPVTKSFNRGEC |
| 257 413G05-full light chain sequence | Nucleic acid sequence of 413G05 light chain | GACATCCAGATGACCCAGTCTCCATCTTCCGTGTCTGCATCTGTAGGAG ACAGAGTCACCATCACTTGTCGGGCGAGTCAGGGTATTAACAGCTGGTT AGCCTGGTATCAGCAGAAACCAGGGAAAGCCCCTAAGCTCCTGATCTAT GCTGCATCCACTTTGCAAAGTGGGGTCCCATCAAGGTTCAGCGGCAGTG GGTCTGGGGCAGATTTCACTCTCACCATCAGCAGCCTGCAGCCTGAAGA TTTTGCAACTTACTATTGTCAACAGGTTAACAGTTTCCCGCTCACTTTC GGCGGAGGGACCAAGGTGGAGATCAAACGTACGGTGGCCGCTCCCTCCG TGTTCATCTTCCCACCTTCCGACGAGCAGCTGAAGTCCGGCACCGCTTC TGTCGTGTGCCTGCTGAACAACTTCTACCCCCGCGAGGCCAAGGTGCAG TGGAAGGTGGACAACGCCCTGCAGTCCGGCAACTCCCAGGAATCCGTGA CCGAGCAGGACTCCAAGGACAGCACCTACTCCCTGTCCTCCACCCTGAC |

TABLE S1 -continued

SEQ ID NOS: 1-342

| SEQ ID NO:Name | Description | Sequence |
|---|---|---|
| | | CCTGTCCAAGGCCGACTACGAGAAGCACAAGGTGTACGCCTGCGAAGTG<br>ACCCACCAGGGCCTGTCTAGCCCCGTGACCAAGTCTTTCAACCGGGGCG<br>AGTGT |
| 258 413F09-CDRH1 (IMGT) | Amino acid sequence of CDRH1 of 413F09 using IMGT | GFTFSYYA |
| 259 413F09-CDRH2 (IMGT) | Amino acid sequence of CDRH2 of 413F09 using IMGT | ISGGGGNT |
| 260 413F09-CDRH3 (IMGT) | Amino acid sequence of CDRH3 of 413F09 using IMGT | AKDRMKQLVRAYYFDY |
| 261 413F09-CDRH1 (Kabat) | Amino acid sequence of CDRH1 of 413F09 using Kabat | YYAMS |
| 262 413F09-CDRH2 (Kabat) | Amino acid sequence of CDRH2 of 413F09 using Kabat | TISGGGGNTHYADSVKG |
| 263 413F09-CDRH3 (Kabat) | Amino acid sequence of CDRH3 of 413F09 using Kabat | DRMKQLVRAYYFDY |
| 264 413F09-Heavy chain variable region | Amino acid sequence of $V_H$ of 413F09 | EVPLVESGGGLVQPGGSLRLSCAASGFTFSYYAMSWVRQAPGKGLDWVS<br>TISGGGGNTHYADSVKGRFTISRDNSKNTLYLHMNSLRAEDTAVYYCAK<br>DRMKQLVRAYYFDYWGQGTLVTVSS |
| 265 413F09-Heavy chain variable region | Nucleic acid sequence of $V_H$ of 413F09 | GAGGTGCCGCTGGTGGAGTCTGGGGGAGGCTTGGTACAGCCTGGGGGGT<br>CCCTGAGACTCTCCTGTGCAGCCTCTGGATTCACGTTTAGCTACTATGC<br>CATGAGCTGGGTCCGTCAGGCTCCAGGGAAGGGGCTGGACTGGGTCTCA<br>ACTATTAGTGGTGGTGGTGGTAACACACACTACGCAGACTCCGTGAAGG<br>GCCGATTCACTATATCCAGAGACAATTCCAAGAACACGCTGTATCTGCA<br>CATGAACAGCCTGAGAGCCGAAGACACGGCCGTCTATTACTGTGCAAAG<br>GATCGGATGAAACAGCTCGTCCGGGCCTACTACTTTGACTACTGGGGCC<br>AGGGAACCCTGGTCACCGTCTCCTCAG |
| 266 413F09-full heavy chain sequence | Amino acid sequence of 413F09 heavy chain | EVPLVESGGGLVQPGGSLRLSCAASGFTFSYYAMSWVRQAPGKGLDWVS<br>TISGGGGNTHYADSVKGRFTISRDNSKNTLYLHMNSLRAEDTAVYYCAK<br>DRMKQLVRAYYFDYWGQGTLVTVSSASTKGPSVFPLAPSSKSTSGGTAA<br>LGCLVKDYFPEPVTVSWNSGALTSGVHTFPAVLQSSGLYSLSSVVTVPS<br>SSLGTQTYICNVNHKPSNTKVDKKVEPKSCDKTHTCPPCPAPELLGGPS<br>VFLFPPKPKDTLMISRTPEVTCVVVDVSHEDPEVKFNWYVDGVEVHNAK<br>TKPREEQYNSTYRVVSVLTVLHQDWLNGKEYKCKVSNKALPAPIEKTIS<br>KAKGQPREPQVYTLPPSRDELTKNQVSLTCLVKGFYPSDIAVEWESNGQ<br>PENNYKTTPPVLDSDGSFFLYSKLTVDKSRWQQGNVFSCSVMHEALHNH<br>YTQKSLSLSPGK |
| 267 413F09-full heavy chain sequence | Nucleic acid sequence of 413F09 heavy chain | GAGGTGCCGCTGGTGGAGTCTGGGGGAGGCTTGGTACAGCCTGGGGGGT<br>CCCTGAGACTCTCCTGTGCAGCCTCTGGATTCACGTTTAGCTACTATGC<br>CATGAGCTGGGTCCGTCAGGCTCCAGGGAAGGGGCTGGACTGGGTCTCA<br>ACTATTAGTGGTGGTGGTGGTAACACACACTACGCAGACTCCGTGAAGG<br>GCCGATTCACTATATCCAGAGACAATTCCAAGAACACGCTGTATCTGCA<br>CATGAACAGCCTGAGAGCCGAAGACACGGCCGTCTATTACTGTGCAAAG<br>GATCGGATGAAACAGCTCGTCCGGGCCTACTACTTTGACTACTGGGGCC<br>AGGGAACCCTGGTCACCGTCTCCTCAGCCAGCACCAAGGGCCCCTCTGT<br>GTTCCCTCTGGCCCCTTCCAGCAAGTCCACCTCTGGCGGAACAGCCGCT<br>CTGGGCTGCCTCGTGAAGGACTACTTCCCCGAGCCTGTGACCGTGTCCT<br>GGAACTCTGGCGCTCTGACCAGCGGAGTGCACACCTTCCCTGCTGTGCT<br>GCAGTCCTCCGGCCTGTACTCCCTGTCCTCCGTCGTGACCGTGCCTTCC<br>AGCTCTCTGGGCACCCAGACCTACATCTGCAACGTGAACCACAAGCCCT<br>CCAACACCAAGGTGGACAAGAAGGTGGAACCCAAGTCCTGCGACAAGAC<br>CCACACCTGTCCCCCTTGTCCTGCCCCTGAACTGCTGGGCGGACCTTCC<br>GTGTTCCTGTTCCCCCCAAAGCCCAAGGACACCCTGATGATCTCCCGGA<br>CCCCCGAAGTGACCTGCGTGGTGGTGGATGTGTCCCACGAGGACCCTGA<br>AGTGAAGTTCAATTGGTACGTGGACGGCGTGGAAGTGCACAACGCCAAG<br>ACCAAGCCTAGAGAGGAACAGTACAACTCCACCTACCGGGTGGTGTCCG<br>TGCTGACCGTGCTGCACCAGGATTGGCTGAACGGCAAAGAGTACAAGTG<br>CAAGGTGTCCAACAAGGCCCTGCCTGCCCCCATCGAAAAGACCATCTCC |

TABLE S1 -continued

SEQ ID NOS: 1-342

| SEQ ID NO:Name | Description | Sequence |
|---|---|---|
| | | AAGGCCAAGGGCCAGCCCCGGGAACCCCAGGTGTACACACTGCCCCCTA GCAGGGACGAGCTGACCAAGAACCAGGTGTCCCTGACCTGTCTCGTGAA AGGCTTCTACCCCTCCGATATCGCCGTGGAATGGGAGTCCAACGGCCAG CCTGAGAACAACTACAAGACCACCCCCCCTGTGCTGGACTCCGACGGCT CATTCTTCCTGTACAGCAAGCTGACAGTGGACAAGTCCCGGTGGCAGCA GGGCAACGTGTTCTCCTGCTCCGTGATGCACGAGGCCCTGCACAACCAC TACACCCAGAAGTCCCTGTCCCTGAGCCCCGGCAAG |
| 268 413F09-CDRL1 (IMGT) | Amino acid sequence of CDRL1 of 413F09 using IMGT | QDISTY |
| 269 413F09-CDRL2 (IMGT) | Amino acid sequence of CDRL2 of 413F09 using IMGT | GTS |
| 270 413F09-CDRL3 (IMGT) | Amino acid sequence of CDRL3 of 413F09 using IMGT | QQLHTDPIT |
| 271 413F09-CDRL1 (Kabat) | Amino acid sequence of CDRL1 of 413F09 using Kabat | WASQDISTYLG |
| 272 413F09-CDRL2 (Kabat) | Amino acid sequence of CDRL2 of 413F09 using Kabat | GTSSLQS |
| 273 413F09-CDRL3 (Kabat) | Amino acid sequence of CDRL3 of 413F09 using Kabat | QQLHTDPIT |
| 274 413F09-Light chain variable region | Amino acid sequence of VL of 413F09 | DIQLTQSPSFLSASVGDRVTITCWASQDISTYLGWYQQKPGKAPKLLIY GTSSLQSGVPSRFSGSGSGTEFTLTISSLQPEDFATYYCQQLHTDPITF GQGTRLEIK |
| 275 413F09-Light chain variable region | Nucleic acid sequence of VL of 413F09 | GACATCCAGTTGACCCAGTCTCCATCCTTCCTGTCTGCATCTGTAGGAG ACAGAGTCACCATCACTTGCTGGGCCAGTCAGGACATTAGCACTTATTT AGGCTGGTATCAGCAAAAACCAGGGAAAGCCCCTAAGCTCCTGATCTAT GGTACATCCAGTTTGCAAAGTGGGGTCCCATCAAGGTTCAGCGGCAGTG GATCTGGGACAGAATTCACTCTCACAATCAGCAGCCTGCAGCCTGAAGA TTTTGCAACTTATTACTGTCAACAGCTTCATACTGACCCGATCACCTTC GGCCAAGGGACACGACTGGAGATCAAAC |
| 276 413F09-full light chain sequence | Amino acid sequence of 413F09 light chain | DIQLTQSPSFLSASVGDRVTITCWASQDISTYLGWYQQKPGKAPKLLIY GTSSLQSGVPSRFSGSGSGTEFTLTISSLQPEDFATYYCQQLHTDPITF GQGTRLEIKRTVAAPSVFIFPPSDEQLKSGTASVVCLLNNFYPREAKVQ WKVDNALQSGNSQESVTEQDSKDSTYSLSSTLTLSKADYEKHKVYACEV THQGLSSPVTKSFNRGEC |
| 277 413F09-full light chain sequence | Nucleic acid sequence of 413F09 light chain | GACATCCAGTTGACCCAGTCTCCATCCTTCCTGTCTGCATCTGTAGGAG ACAGAGTCACCATCACTTGCTGGGCCAGTCAGGACATTAGCACTTATTT AGGCTGGTATCAGCAAAAACCAGGGAAAGCCCCTAAGCTCCTGATCTAT GGTACATCCAGTTTGCAAAGTGGGGTCCCATCAAGGTTCAGCGGCAGTG GATCTGGGACAGAATTCACTCTCACAATCAGCAGCCTGCAGCCTGAAGA TTTTGCAACTTATTACTGTCAACAGCTTCATACTGACCCGATCACCTTC GGCCAAGGGACACGACTGGAGATCAAACGTACGGTGGCCGCTCCCTCCG TGTTCATCTTCCCACCTTCCGACGAGCAGCTGAAGTCCGGCACCGCTTC TGTCGTGTGCCTGCTGAACAACTTCTACCCCCGCGAGGCCAAGGTGCAG TGGAAGGTGGACAACGCCCTGCAGTCCGGCAACTCCCAGGAATCCGTGA CCGAGCAGGACTCCAAGGACAGCACCTACTCCCTGTCCTCCACCCTGAC CCTGTCCAAGGCCGACTACGAGAAGCACAAGGTGTACGCCTGCGAAGTG ACCCACCAGGGCCTGTCTAGCCCCGTGACCAAGTCTTTCAACCGGGGCG AGTGT |
| 278 414B06-CDRH1 (IMGT) | Amino acid sequence of CDRH1 of 414B06 using IMGT | GFTFSSYW |
| 279 414B06-CDRH2 (IMGT) | Amino acid sequence of CDRH2 of 414B06 using IMGT | IKQDGSEK |

TABLE S1 -continued

SEQ ID NOS: 1-342

| SEQ ID NO:Name | Description | Sequence |
|---|---|---|
| 280 414B06-CDRH3 (IMGT) | Amino acid sequence of CDRH3 of 414B06 using IMGT | ARVRQWSDYSDY |
| 281 414B06-CDRH1 (Kabat) | Amino acid sequence of CDRH1 of 414B06 using Kabat | SYWMN |
| 282 414B06-CDRH2 (Kabat) | Amino acid sequence of CDRH2 of 414B06 using Kabat | NIKQDGSEKYYVDSVKG |
| 283 414B06-CDRH3 (Kabat) | Amino acid sequence of CDRH3 of 414B06 using Kabat | VRQWSDYSDY |
| 284 414B06-Heavy chain variable region | Amino acid sequence of VH of 414B06 | EVHLVESGGGLVQPGGSLRLSCAASGFTFSSYWMNWVRQAPGKGLEWVA NIKQDGSEKYYVDSVKGRFTVSRDNAKNSLYLQMNSLRAEDTAVYYCAR VRQWSDYSDYWGQGTPVTVSS |
| 285 414B06-Heavy chain variable region | Nucleic acid sequence of VH of 414B06 | GAGGTGCACCTGGTGGAGTCTGGGGGAGGCTTGGTCCAGCCTGGGGGGT CCCTGAGACTCTCCTGTGCAGCCTCTGGATTCACCTTTAGTAGCTATTG GATGAACTGGGTCCGCCAGGCTCCAGGGAAGGGGCTGGAGTGGGTGGCC AACATAAAGCAAGATGGAAGTGAGAAATACTATGTGGACTCTGTGAAGG GCCGCTTCACCGTCTCCAGAGACAACGCCAAGAACTCACTGTATCTGCA AATGAACAGCCTGAGAGCCGAGGACACGGCTGTGTATTACTGTGCGAGA GTTCGACAATGGTCCGACTACTCTGACTACTGGGGCCAGGGAACCCCGG TCACCGTCTCCTCAG |
| 286 414B06-full heavy chain sequence | Amino acid sequence of 414B06 heavy chain | EVHLVESGGGLVQPGGSLRLSCAASGFTFSSYWMNWVRQAPGKGLEWVA NIKQDGSEKYYVDSVKGRFTVSRDNAKNSLYLQMNSLRAEDTAVYYCAR VRQWSDYSDYWGQGTPVTVSSASTKGPSVFPLAPSSKSTSGGTAALGCL VKDYFPEPVTVSWNSGALTSGVHTFPAVLQSSGLYSLSSVVTVPSSSLG TQTYICNVNHKPSNTKVDKKVEPKSCDKTHTCPPCPAPELLGGPSVFLF PPKPKDTLMISRTPEVTCVVVDVSHEDPEVKFNWYVDGVEVHNAKTKPR EEQYNSTYRVVSVLTVLHQDWLNGKEYKCKVSNKALPAPIEKTISKAKG QPREPQVYTLPPSRDELTKNQVSLTCLVKGFYPSDIAVEWESNGQPENN YKTTPPVLDSDGSFFLYSKLTVDKSRWQQGNVFSCSVMHEALHNHYTQK SLSLSPGK |
| 287 414B06-full heavy chain sequence | Nucleic acid sequence of 414B06 heavy chain | GAGGTGCACCTGGTGGAGTCTGGGGGAGGCTTGGTCCAGCCTGGGGGGT CCCTGAGACTCTCCTGTGCAGCCTCTGGATTCACCTTTAGTAGCTATTG GATGAACTGGGTCCGCCAGGCTCCAGGGAAGGGGCTGGAGTGGGTGGCC AACATAAAGCAAGATGGAAGTGAGAAATACTATGTGGACTCTGTGAAGG GCCGCTTCACCGTCTCCAGAGACAACGCCAAGAACTCACTGTATCTGCA AATGAACAGCCTGAGAGCCGAGGACACGGCTGTGTATTACTGTGCGAGA GTTCGACAATGGTCCGACTACTCTGACTACTGGGGCCAGGGAACCCCGG TCACCGTCTCCTCAGCCAGCACCAAGGGCCCCTCTGTGTTCCCTCTGGC CCCTTCCAGCAAGTCCACCTCTGGCGGAACAGCCGCTCTGGGCTGCCTC GTGAAGGACTACTTCCCCGAGCCTGTGACCGTGTCCTGGAACTCTGGCG CTCTGACCAGCGGAGTGCACACCTTCCCTGCTGTGCTGCAGTCCTCCGG CCTGTACTCCCTGTCCTCCGTCGTGACCGTGCCTTCCAGCTCTCTGGGC ACCCAGACCTACATCTGCAACGTGAACCACAAGCCCTCCAACACCAAGG TGGACAAGAAGGTGGAACCCAAGTCCTGCGACAAGACCCACACCTGTCC CCCTTGTCCTGCCCCTGAACTGCTGGGCGGACCTTCCGTGTTCCTGTTC CCCCCAAAGCCCAAGGACACCCTGATGATCTCCCGGACCCCCGAAGTGA CCTGCGTGGTGGTGGATGTGTCCCACGAGGACCCTGAAGTGAAGTTCAA TTGGTACGTGGACGGCGTGGAAGTGCACAACGCCAAGACCAAGCCTAGA GAGGAACAGTACAACTCCACCTACCGGGTGGTGTCCGTGCTGACCGTGC TGCACCAGGATTGGCTGAACGGCAAAGAGTACAAGTGCAAGGTGTCCAA CAAGGCCCTGCCTGCCCCATCGAAAAGACCATCTCCAAGGCCAAGGGC CAGCCCCGGGAACCCCAGGTGTACACACTGCCCCCTAGCAGGGACGAGC TGACCAAGAACCAGGTGTCCCTGACCTGTCTCGTGAAAGGCTTCTACCC CTCCGATATCGCCGTGGAATGGGAGTCCAACGGCCAGCCTGAGAACAAC TACAAGACCACCCCCCCTGTGCTGGACTCCGACGGCTCATTCTTCCTGT ACAGCAAGCTGACAGTGGACAAGTCCCGGTGGCAGCAGGGCAACGTGTT CTCCTGCTCCGTGATGCACGAGGCCCTGCACAACCACTACACCCAGAAG TCCCTGTCCCTGAGCCCCGGCAAG |

TABLE S1 -continued

SEQ ID NOS: 1-342

| SEQ ID NO: | Name | Description | Sequence |
|---|---|---|---|
| 288 | 414B06-CDRL1 (IMGT) | Amino acid sequence of CDRL1 of 414B06 using IMGT | QGISSW |
| 289 | 414B06-CDRL2 (IMGT) | Amino acid sequence of CDRL2 of 414B06 using IMGT | AAS |
| 290 | 414B06-CDRL3 (IMGT) | Amino acid sequence of CDRL3 of 414B06 using IMGT | QQANSFPFT |
| 291 | 414B06-CDRL1 (Kabat) | Amino acid sequence of CDRL1 of 414B06 using Kabat | RASQGISSWLA |
| 292 | 414B06-CDRL2 (Kabat) | Amino acid sequence of CDRL2 of 414B06 using Kabat | AASSLQS |
| 293 | 414B06-CDRL3 (Kabat) | Amino acid sequence of CDRL3 of 414B06 using Kabat | QQANSFPFT |
| 294 | 414B06-Light chain variable region | Amino acid sequence of VL of 414B06 | DIQMTQSPSSVSASVGDRVTITCRASQGISSWLAWYQQKPGKAPKLLIY AASSLQSGVPSRFSGSGSGTDFTLTISSLQPEDFATYYCQQANSFPFTF GPGTKVDIK |
| 295 | 414B06-Light chain variable region | Nucleic acid sequence of VL of 414B06 | GACATCCAGATGACCCAGTCTCCATCTTCCGTGTCTGCATCTGTAGGAG ACAGAGTCACCATCACTTGTCGGGCGAGTCAGGGTATTAGCAGCTGGTT AGCCTGGTATCAGCAGAAACCAGGGAAAGCCCCTAAGCTCCTGATCTAT GCTGCATCCAGTTTGCAAAGTGGGGTCCCATCAAGGTTCAGCGGCAGTG GATCTGGGACAGATTTCACTCTCACCATCAGCAGCCTGCAGCCTGAAGA TTTTGCAACTTACTATTGTCAACAGGCTAACAGTTTCCCATTCACTTTC GGCCCTGGGACCAAAGTGGATATCAAAC |
| 296 | 414B06-full light chain sequence | Amino acid sequence of 414B06 light chain | DIQMTQSPSSVSASVGDRVTITCRASQGISSWLAWYQQKPGKAPKLLIY AASSLQSGVPSRFSGSGSGTDFTLTISSLQPEDFATYYCQQANSFPFTF GPGTKVDIKRTVAAPSVFIFPPSDEQLKSGTASVVCLLNNFYPREAKVQ WKVDNALQSGNSQESVTEQDSKDSTYSLSSTLTLSKADYEKHKVYACEV THQGLSSPVTKSFNRGEC |
| 297 | 414B06-full light chain sequence | Nucleic acid sequence of 414B06 light chain | GACATCCAGATGACCCAGTCTCCATCTTCCGTGTCTGCATCTGTAGGAG ACAGAGTCACCATCACTTGTCGGGCGAGTCAGGGTATTAGCAGCTGGTT AGCCTGGTATCAGCAGAAACCAGGGAAAGCCCCTAAGCTCCTGATCTAT GCTGCATCCAGTTTGCAAAGTGGGGTCCCATCAAGGTTCAGCGGCAGTG GATCTGGGACAGATTTCACTCTCACCATCAGCAGCCTGCAGCCTGAAGA TTTTGCAACTTACTATTGTCAACAGGCTAACAGTTTCCCATTCACTTTC GGCCCTGGGACCAAAGTGGATATCAAACGTACGGTGGCCGCTCCCTCCG TGTTCATCTTCCCACCTTCCGACGAGCAGCTGAAGTCCGGCACCGCTTC TGTCGTGTGCCTGCTGAACAACTTCTACCCCCGCGAGGCCAAGGTGCAG TGGAAGGTGGACAACGCCCTGCAGTCCGGCAACTCCCAGGAATCCGTGA CCGAGCAGGACTCCAAGGACAGCACCTACTCCCTGTCCTCCACCCTGAC CCTGTCCAAGGCCGACTACGAGAAGCACAAGGTGTACGCCTGCGAAGTG ACCCACCAGGGCCTGTCTAGCCCCGTGACCAAGTCTTTCAACCGGGGCG AGTGT |
| 298 | Mutated 1D05-LC mutant 3 | Amino acid sequence of 1D05 kappa light chain with V to Y mutation in CDRL2 highlighted | DIQMTQSPSSLSASVGDRVTITCRASQSISSYLNWYQQKPGKAPKLLIY YASSLQSGVPSRFSGSGSGTDFTLTISSLQPEDFATYYCQQSYSTPITF GQGTRLEIKRTVAAPSVFIFPPSDEQLKSGTASVVCLLNNFYPREAKVQ WKVDNALQSGNSQESVTEQDSKDSTYSLSSTLTLSKADYEKHKVYACEV THQGLSSPVTKSFNRGEC |
| 299 | 1D05-heavy chain disabled IgG1 Fc | Amino acid sequence of IgG1 disabled variant of 1D05 | EVQLVESGGGLVQPGRSLRLSCAASGFTFDDYAMHWVRQVPGKGLEWVS GISWIRTGIGYADSVKGRFTIFRDNAKNSLYLQMNSLRAEDTALYYCAK DMKGSGTYGGWFDTWGQGTLVTVSSASTKGPSVFPLAPSSKSTSGGTAA LGCLVKDYFPEPVTVSWNSGALTSGVHTFPAVLQSSGLYSLSSVVTVPS SSLGTQTYICNVNHKPSNTKVDKKVEPKSCDKTHTCPPCPAPELAGAPS VFLFPPKPKDTLMISRTPEVTCVVVDVSHEDPEVKFNWYVDGVEVHNAK |

TABLE S1 -continued

SEQ ID NOS: 1-342

| SEQ ID NO: | Name | Description | Sequence |
|---|---|---|---|
| | | | TKPREEQYNSTYRVVSVLTVLHQDWLNGKEYKCKVSNKALPAPIEKTIS KAKGQPREPQVYTLPPSRDELTKNQVSLTCLVKGFYPSDIAVEWESNGQ PENNYKTTPPVLDSDGSFFLYSKLTVDKSRWQQGNVFSCSVMHEALHNH YTQKSLSLSPGK |
| 300 | 1D05-light chain IL-2 fusion | 1D05 Light chain sequence fused to wild-type human IL-2 sequence (IL-2 amino acid sequence is underlined and region to be varied is shown in bold) | DIQMTQSPSSLSASVGDRVTITCRASQSISSYLNWYQQKPGKAPKLLIY VASSLQSGVPSRFSGSGSGTDFTLTISSLQPEDFATYYCQQSYSTPITF GQGTRLEIKRTVAAPSVFIFPPSDEQLKSGTASVVCLLNNFYPREAKVQ WKVDNALQSGNSQESVTEQDSKDSTYSLSSTLTLSKADYEKHKVYACEV THQGLSSPVTKSFNRGECAPTSSSTKKTQLQLEHLLLDLQMILNGINNY KNPKLTRMLTFKFYMPKKATELKHLQCLEEELKPLEEVLNLAQSKNFHL RPRDLISNINVIVLELKGSETTFMCEYADETATIVEFLNRWITFCQSII STLT |
| 301 | Human IL-2 | Uniprot number: P60568 Full length amino acid sequence of human IL-2 (minus signal sequence) | APTSSSTKKTQLQLEHLLLDLQMILNGINNYKNPKLTRMLTFKFYMPKK ATELKHLQCLEEELKPLEEVLNLAQSKNFHLRPRDLISNINVIVLELKG SETTFMCEYADETATIVEFLNRWITFCQSIISTLT |
| 302 | Control 1D05 immunocyt okine HC C-terminal fusion | Heavy chain 1D05 IgG1 variant fused at the N-terminus to wild-type human IL2 sequence (control) | EVQLVESGGGLVQPGRSLRLSCAASGFTFDDYAMHWVRQVPGKGLEWVS GISWIRTGIGYADSVKGRFTIFRDNAKNSLYLQMNSLRAEDTALYYCAK DMKGSGTYGGWFDTWGQGTLVTVSSASTKGPSVFPLAPSSKSTSGGTAA LGCLVKDYFPEPVTVSWNSGALTSGVHTFPAVLQSSGLYSLSSVVTVPS SSLGTQTYICNVNHKPSNTKVDKKVEPKSCDKTHTCPPCPAPELAGAPS VFLFPPKPKDTLMISRTPEVTCVVVDVSHEDPEVKFNWYVDGVEVHNAK TKPREEQYNSTYRVVSVLTVLHQDWLNGKEYKCKVSNKALPAPIEKTIS KAKGQPREPQVYTLPPSRDELTKNQVSLTCLVKGFYPSDIAVEWESNGQ PENNYKTTPPVLDSDGSFFLYSKLTVDKSRWQQGNVFSCSVMHEALHNH YTQKSLSLSPGKAPTSSSTKKTQLQLEHLLLDLQMILNGINNYKNPKLT RMLTFKFYMPKKATELKHLQCLEEELKPLEEVLNLAQSKNFHLRPRDLI SNINVIVLELKGSETTFMCEYADETATIVEFLNRWITFCQSIISTLT |
| 303 | IL-2 D5-9 | IL-2 1045 (Del 5-9) N terminal IL-2 sequence | APTSTQLQLEHLLLD |
| 304 | IL-2 D1-9 | IL-2 1046 (Del 1-9) N terminal IL-2 sequence | TQLQLEHLLLD |
| 305 | IL-2 D5-7 | IL-2 1064 (Del 5-7) N terminal IL-2 sequence | APTSKKTQLQLEHLLLD |
| 306 | IL-2 D1 | IL-2 D1 N terminal IL-2 sequence | PTSSSTKKTQLQLEHLLLD |
| 307 | IL-2 D1-2 | IL-2 D1-2 N terminal IL-2 sequence | TSSSTKKTQLQLEHLLLD |
| 308 | IL-2 D1-3 | IL-2 D1-3 N terminal IL-2 sequence | SSSTKKTQLQLEHLLLD |
| 309 | IL-2 D1-4 | IL-2 D1-4 N terminal IL-2 sequence | SSTKKTQLQLEHLLLD |
| 310 | IL-2 D1-5 | IL-2 D1-5 N terminal IL-2 sequence | STKKTQLQLEHLLLD |
| 311 | IL-2 D1-6 | IL-2 D1-6 N terminal IL-2 sequence | TKKTQLQLEHLLLD |
| 312 | IL-2 D1-7 | IL-2 D1-7 N terminal IL-2 sequence | KKTQLQLEHLLLD |
| 313 | IL-2 D1-8 | IL-2 D1-8 N terminal IL-2 sequence | KTQLQLEHLLLD |

TABLE S1 -continued

SEQ ID NOS: 1-342

| SEQ ID NO:Name | Description | Sequence |
|---|---|---|
| 314 IL-2 D9 | IL-2 D9 N terminal IL-2 sequence | APTSSSTKTQLQLEHLLLD |
| 315 IL-2 D9-8 | IL-2 D9-8 N terminal IL-2 sequence | APTSSSTTQLQLEHLLLD |
| 316 IL-2 D9-7 | IL-2 D9-7 N terminal IL-2 sequence | APTSSSTQLQLEHLLLD |
| 317 IL-2 D9-6 | IL-2 D9-6 N terminal IL-2 sequence | APTSSTQLQLEHLLLD |
| 318 IL-2 D9-4 | IL-2 D9-4 N terminal IL-2 sequence | APTTQLQLEHLLLD |
| 319 IL-2 D9-3 | IL-2 D9-3 N terminal IL-2 sequence | APTQLQLEHLLLD |
| 320 IL-2 D9-2 | IL-2 D9-2 N terminal IL-2 sequence | ATQLQLEHLLLD |
| 321 IL-2 D2-6 | IL-2 D2-6 N terminal IL-2 sequence | ATKKTQLQLEHLLLD |
| 322 IL-2 D3-7 | IL-2 D3-7 N terminal IL-2 sequence | APKKTQLQLEHLLLD |
| 323 IL-2 D4-8 | IL-2 D4-8 N terminal IL-2 sequence | APTKTQLQLEHLLLD |
| 324 C-terminal amino acid sequence of hIL-2 | Amino acids 21 to 133 of hIL-2 | LQMILNGINNYKNPKLTRMLTFKFYMPKKATELKHLQCLEEELKPLEEV LNLAQSKNFHLRPRDLISNINVIVLELKGSETTFMCEYADETATIVEFL NRWITFCQSIISTLT |
| 325 Mouse PD-L1 | Uniprot number: Q9EP73 (ECD highlighted in BOLD, and cytoplasmic domain underlined) | MRIFAGIIFTACCHLLRAFTITAPKDLYVVEYGSNVTMECRFPVERELD LLALVVYWEKEDEQVIQFVAGEEDLKPQHSNFRGRASLPKDQLLKGNAA LQITDVKLQDAGVYCCIISYGGADYKRITLKVNAPYRKINQRISVDPAT SEHELICQAEGYPEAEVIWTNSDHQPVSGKRSVTTSRTEGMLLNVTSSL RVNATANDVFYCTFWRSQPGQNHTAELIIPELPATHPPQNRT<u>HWVLLGS ILLFLIVVSTVLLFLRKQVRMLDVEKCGVEDTSSKNRNDTQFEET</u> |
| 326 Mouse PD-L1 ECD His | Mouse PD-L1 extracellular domain with his tag | FTITAPKDLYVVEYGSNVTMECRFPVERELDLLALVVYWEKEDEQVIQF VAGEEDLKPQHSNFRGRASLPKDQLLKGNAALQITDVKLQDAGVYCCII SYGGADYKRITLKVNAPYRKINQRISVDPATSEHELICQAEGYPEAEVI WTNSDHQPVSGKRSVTTSRTEGMLLNVTSSLRVNATANDVFYCTFWRSQ PGQNHTAELIIPELPATHPPQNRTHHHHHH |
| 327 Human IL-2Rα chain | Human IL-2 receptor alpha chain | ELCDDDPPEIPHATFKAMAYKEGTMLNCECKRGFRRIKSGSLYMLCTGN SSHSSWDNQCQCTSSATRNTTKQVTPQPEEQKERKTTEMQSPMQPVDQA SLPGHCREPPPWENEATERIYHFVVGQMVYYQCVQGYRALHRGPAESVC KMTHGKTRWTQPQLICTGEMETSQFPGEEKPQASPEGRPESETSCLVTT TDFQIQTEMAATMETSIFTTEYQVAVAGCVFLLISVLLLSGLTWQRRQR KSRRTI |
| 328 Human IL-2Rβ chain | Human IL-2 receptor beta chain | AVNGTSQFTCFYNSRANISCVWSQDGALQDTSCQVHAWPDRRRWNQTCE LLPVSQASWACNLILGAPDSQKLTTVDIVTLRVLCREGVRWRVMAIQDF KPFENLRLMAPISLQVVHVETHRCNISWEISQASHYFERHLEFEARTLS PGHTWEEAPLLTLKQKQEWICLETLTPDTQYEFQVRVKPLQGEFTTWSP WSQPLAFRTKPAALGKDTIPWLGHLLVGLSGAFGFIILVYLLINCRNTG PWLKKVLKCNTPDPSKFFSQLSSEHGGDVQKWLSSPFPSSSFSPGGLAP EISPLEVLERDKVTQLLLQQDKVPEPASLSSNHSLTSCFTNQGYFFFHL PDALEIEACQVYFTYDPYSEEDPDEGVAGAPTGSSPQPLQPLSGEDDAY CTFPSRDDLLLFSPSLLGGPSPPSTAPGGSGAGEERMPPSLQERVPRDW DPQPLGPPTPGVPDLVDFQPPPELVLREAGEEVPDAGPREGVSFPWSRP PGQGEFRALNARLPLNTDAYLSLQELQGQDPTHLV |
| 329 Human IL-2Rγ chain | Human IL-2 receptor common gamma chain | LNTTILTPNGNEDTTADFFLTTMPTDSLSVSTLPLPEVQCFVFNVEYMN CTWNSSSEPQPTNLTLHYWYKNSDNDKVQKCSHYLFSEEITSGCQLQKK EIHLYQTFVVQLQDPREPRRQATQMLKLQNLVIPWAPENLTLHKLSESQ LELNWNNRFLNHCLEHLVQYRTDWDHSWTEQSVDYRHKFSLPSVDGQKR YTFRVRSRFNPLCGSAQHWSEWSHPIHWGSNTSKENPFLFALEAVVISV |

TABLE S1 -continued

SEQ ID NOS: 1-342

| SEQ ID NO:Name | Description | | | Sequence |
|---|---|---|---|---|
| | | | | GSMGLIISLLCVYFWLERTMPRIPTLKNLEDLVTEYHGNFSAWSGVSKG LAESLQPDYSERLCLVSEIPPKGGALGEGPGASPCNQHSPYWAPPCYTL KPET |
| 330 IL-7 | Human IL-7 amino acid sequence | | | DCDIEGKDGKQYESVLMVSIDQLLDSMKEIGSNCLNNEFNFFKRHICDA NKEGMFLFRAARKLRQFLKMNSTGDFDLHLLKVSEGTTILLNCTGQVKG RKPAALGEAQPTKSLEENKSLKEQKKLNDLCFLKRLLQEIKTCWNKILM GTKEH |
| 331 IL-15 | Human IL-15 amino acid sequence | | | GIHVFILGCFSAGLPKTEANWVNVISDLKKIEDLIQSMHIDATLYTESD VHPSCKVTAMKCFLLELQVISLESGDASIHDTVENLIILANNSLSSNGN VTESGCKECEELEEKNIKEFLQSFVHIVQMFINTS |
| 332 IL-21 | Human IL-21 amino acid sequence | | | QGQDRHMIRMRQLIDIVDQLKNYVNDLVPEFLPAPEDVETNCEWSAFSC FQKAQLKSANTGNNERIINVSIKKLKRKPPSTNAGRRQKHRLTCPSCDS YEKKPPKEFLERFKSLLQKMIHQHLSSRTHGSEDS |
| 333 GM-CSF | Human GM-CSF amino acid sequence | | | APARSPSPSTQPWEHVNAIQEARRLLNLSRDTAAEMNETVEVISEMFDL QEPTCLQTRLELYKQGLRGSLTKLKGPLTMMASHYKQHCPPTPETSCAT QIITFESFKENLKDFLLVIPFDCWEPVQE |
| 334 IFNα | Human IFN-a amino acid sequence | | | CDLPQNHGLLSRNTLVLLHQMRRISPFLCLKDRRDFRFPQEMVKGSQLQ KAHVMSVLHEMLQQIFSLFHTERSSAAWNMTLLDQLHTELHQQLQHLET CLLQVVGEGESAGAISSPALTLRRYFQGIRVYLKEKKYSDCAWEVVRME IMKSLFLSTNMQERLRSKDRDLGS |
| 335 TNFα | Extracellular portion of human TNF-α amino acid sequence | | | GPQREEFPRDLSLISPLAQAVRSSSRTPSDKPVAHVVANPQAEGQLQWL NRRANALLANGVELRDNQLVVPSEGLYLIYSQVLFKGQGCPSTHVLLTH TISRIAVSYQTKVNLLSAIKSPCQRETPEGAEAKPWYEPIYLGGVFQLE KGDRLSAEINRPDYLDFAESGQVYFGIIAL |
| 336 IL-12α | Alpha chain of human IL-12 amino acid sequence | | | RNLPVATPDPGMFPCLHHSQNLLRAVSNMLQKARQTLEFYPCTSEEIDH EDITKDKTSTVEACLPLELTKNESCLNSRETSFITNGSCLASRKTSFMM ALCLSSIYEDLKMYQVEFKTMNAKLLMDPKRQIFLDQNMLAVIDELMQA LNFNSETVPQKSSLEEPDFYKTKIKLCILLHAFRIRAVTIDRVMSYLNA S |
| 337 IL-12β | Beta chain of human IL-12 amino acid sequence | | | IWELKKDVYVVELDWYPDAPGEMVVLTCDTPEEDGITWTLDQSSEVLGS GKTLTIQVKEFGDAGQYTCHKGGEVLSHSLLLLHKKEDGIWSTDILKDQ KEPKNKTFLRCEAKNYSGRFTCWWLTTISTDLTFSVKSSRGSSDPQGVT CGAATLSAERVRGDNKEYEYSVECQEDSACPAAEESLPIEVMVDAVHKL KYENYTSSFFIRDIIKPDPPKNLQLKPLKNSRQVEVSWEYPDTWSTPHS YFSLTFCVQVQGKSKREKKDRVFTDKTSATVICRKNASISVRAQDRYYS SSWSEWASVPCS |
| 338 CXCL9 | Human CXCL-9 amino acid sequence | | | TPVVRKGRCSCISTNQGTIHLQSLKDLKQFAPSPSCEKIEIIATLKNGV QTCLNPDSADVKELIKKWEKQVSQKKKQKNGKKHQKKKVLKVRKSQRSR QKKTT |
| 339 CXCL10 | Human CXCL-10 amino acid sequence | | | VPLSRTVRCTCISISNQPVNPRSLEKLEIIPASQFCPRVEIIATMKKKG EKRCLNPESKAIKNLLKAVSKERSKRSP |
| 340 Human WT IgG1 constant region | IGHG1*01 & IGHG1*02 & IGHG1*05 (IgG1) | WT human IgG1 amino acid sequence | | ASTKGPSVFPLAPSSKSTSGGTAALGCLVKDYFPEPVTVSWNSGALTSG VHTFPAVLQSSGLYSLSSVVTVPSSSLGTQTYICNVNHKPSNTKVDKKV EPKSCDKTHTCPPCPAPELLGGPSVFLFPPKPKDTLMISRTPEVTCVVV DVSHEDPEVKFNWYVDGVEVHNAKTKPREEQYNSTYRVVSVLTVLHQDW LNGKEYKCKVSNKALPAPIEKTISKAKGQPREPQVYTLPPSRDELTKNQ VSLTCLVKGFYPSDIAVEWESNGQPENNYKTTPPVLDSDGSFFLYSKLT VDKSRWQQGNVFSCSVMHEALHNHYTQKSLSLSPGK |
| 341 | | WT human IgG1 nucleic acid sequence | | GCCAGCACCAAGGGCCCCTCTGTGTTCCCTCTGGCCCCTTCCAGCAAGT CCACCTCTGGCGGAACAGCCGCTCTGGGCTGCCTCGTGAAGGACTACTT CCCCGAGCCTGTGACCGTGTCCTGGAACTCTGGCGCTCTGACCAGCGGA GTGCACACCTTCCCTGCTGTGCTGCAGTCCTCCGGCCTGTACTCCCTGT CCTCCGTCGTGACCGTGCCTTCCAGCTCTCTGGGCACCCAGACCTACAT CTGCAACGTGAACCACAAGCCCTCCAACACCAAGGTGGACAAGAAGGTG GAACCAAGTCCTGCGCAAGACCCACACCTGTCCCCCTTGTCCTGCCC CTGAACTGCTGGGCGGACCTTCCGTGTTCCTGTTCCCCCCAAAGCCCAA GGACACCCTGATGATCTCCCGGACCCCCGAAGTGACCTGCGTGGTGGTG GATGTGTCCCACGAGGACCCTGAAGTGAAGTTCAATTGGTACGTGGACG GCGTGGAAGTGCACAACGCCAAGACCAAGCCTAGAGAGGAACAGTACAA CTCCACCTACCGGGTGGTGTCCGTGCTGACCGTGCTGCACCAGGATTGG CTGAACGGCAAAGAGTACAAGTGCAAGGTGTCCAACAAGGCCCTGCCTG CCCCCATCGAAAAGACCATCTCCAAGGCCAAGGGCCAGCCCCGGGAACC CCAGGTGTACACACTGCCCCCTAGCAGGGACGAGCTGACCAAGAACCAG |

TABLE S1 -continued

SEQ ID NOS: 1-342

| SEQ ID NO: Name | Description | Sequence |
|---|---|---|
| | | GTGTCCCTGACCTGTCTCGTGAAAGGCTTCTACCCCTCCGATATCGCCG TGGAATGGGAGTCCAACGGCCAGCCTGAGAACAACTACAAGACCACCCC CCCTGTGCTGGACTCCGACGGCTCATTCTTCCTGTACAGCAAGCTGACA GTGGACAAGTCCCGGTGGCAGCAGGGCAACGTGTTCTCCTGCTCCGTGA TGCACGAGGCCCTGCACAACCACTACACCCAGAAGTCCCTGTCCCTGAG CCCCGGCAAGTGATGA |
| 342 Mutated 1D05-HC mutant 2 | Amino acid sequence of 1D05 heavy chain with V to A and F to S back-mutation in framework region to germline highlighted with IgG1 disabled (LAGA) constant region | EVQLVESGGGLVQPGRSLRLSCAASGFTFDDYAMHWVRQAPGKGLEWVS GISWIRTGIGYADSVKGRFTISRDNAKNSLYLQMNSLRAEDTALYYCAK DMKGSGTYGGWFDTWGQGTLVTVSSASTKGPSVFPLAPCSRSTSESTAA LGCLVKDYFPEPVTVSWNSGALTSGVHTFPAVLQSSGLYSLSSVVTVPS SSLGTKTYTCNVDHKPSNTKVDKRVESKYGPPCPPCPAPELAGAPSVFL FPPKPKDTLMISRTPEVTCVVVDVSQEDPEVQFNWYVDGVEVHNAKTKP REEQFNSTYRVVSVLTVLHQDWLNGKEYKCKVSNKGLPSSIEKTISKAK GQPREPQVYTLPPSQEEMTKNQVSLTCLVKGFYPSDIAVEWESNGQPEN NYKTTPPVLDSDGSFFLYSRLTVDKSRWQEGNVFSCSVMHEALHNHYTQ KSLSLSLGK |

TABLE S2

SEQ ID NOS: 343-538

| SEQ ID NO: | Name | Description | Sequence |
|---|---|---|---|
| 343 | 416E01-CDRH1 (IMGT) | Amino acid sequence of CDRH1 of 416E01 using IMGT | GFTFSNYA |
| 344 | 416E01-CDRH2 (IMGT) | Amino acid sequence of CDRH2 of 416E01 using IMGT | ISFSGGTT |
| 345 | 416E01-CDRH3 (IMGT) | Amino acid sequence of CDRH3 of 416E01 using IMGT | AKDEAPAGATFFDS |
| 346 | 416E01-CDRH1 (Kabat) | Amino acid sequence of CDRH1 of 416E01 using Kabat | NYAMS |
| 347 | 416E01-CDRH2 (Kabat) | Amino acid sequence of CDRH2 of 416E01 using Kabat | AISFSGGTTYYADSVKG |
| 348 | 416E01-CDRH3 (Kabat) | Amino acid sequence of CDRH3 of 416E01 using Kabat | DEAPAGATFFDS |
| 349 | 416E01-Heavy chain variable region | Amino acid sequence of V$_H$ of 416E01 (mutations from germline are shown in bold letters) | EVQLAESGGGLVQPGGSLRLSCAASGFTFSNYAMSWVRQTPGKGLEW VSAISFSGGTTYYADSVKGRFTISRDNSKNTLYLHMNSLRADDTAVY YCAKDEAPAGATFFDSWGQGTLVTVSS |
| 350 | 416E01-Heavy chain variable region | Nucleic acid sequence of V$_H$ of 416E01 | GAAGTGCAACTGGCGGAGTCTGGGGGAGGCTTGGTACAGCCGGGGGG GTCCCTGAGACTCTCCTGTGCAGCCTCTGGATTCACCTTTAGCAACT ATGCCATGAGTTGGGTCCGCCAGACTCCAGGAAAGGGGCTGGAGTGG GTCTCAGCTATTAGTTTTAGTGGTGGTACTACATACTACGCTGACTC CGTGAAGGGCCGTTCACCATCTCCAGAGACAATTCCAAGAACACGC TGTATTTGCACATGAACAGCCTGAGAGCCGATGACACGGCCGTATAT TACTGTGCGAAAGATGAGGCACCAGCTGGCGCAACCTTCTTTGACTC CTGGGGCCAGGGAACGCTGGTCACCGTCTCCTCAG |
| 351 | 416E01-full heavy chain sequence | Amino acid sequence of 416E01 heavy chain | EVQLAESGGGLVQPGGSLRLSCAASGFTFSNYAMSWVRQTPGKGLEW VSAISFSGGTTYYADSVKGRFTISRDNSKNTLYLHMNSLRADDTAVY YCAKDEAPAGATFFDSWGQGTLVTVSSASTKGPSVFPLAPCSRSTSE STAALGCLVKDYFPEPVTVSWNSGALTSGVHTFPAVLQSSGLYSLSS VVTVPSSSLGTKTYTCNVDHKPSNTKVDKRVESKYGPPCPPCPAPEF EGGPSVFLFPPKPKDTLMISRTPEVTCVVVDVSQEDPEVQFNWYVDG |

TABLE S2-continued

| | | SEQ ID NOS: 343-538 |
|---|---|---|
| 352 | 416E01-full heavy chain sequence | VEVHNAKTKPREEQFNSTYRVVSVLTVLHQDWLNGKEYKCKVSNKGL PSSIEKTISKAKGQPREPQVYTLPPSQEEMTKNQVSLTCLVKGFYPS DIAVEWESNGQPENNYKTTPPVLDSDGSFFLYSRLTVDKSRWQEGNV FSCSVMHEALHNHYTQKSLSLSLGK |
| | Nucleic acid sequence of 416E01 heavy chain | GAAGTGCAACTGGCGGCGGAGTCTGGGGGAGGCTTGGTACAGCCGGGGGG GTCCCTGAGACTCTCCTGTGCAGCCTCTGGATTCACCTTTAGCAACT ATGCCATGAGTTGGGTCCGCCAGACTCCAGGAAAGGGGCTGGAGTGG GTCTCAGCTATTAGTTTTAGTGGTGTACTATACATACGCTGACTC CGTGAAGGGCCGGTTCACCATCTCCAGAGACAATTCCAAGAACACGC TGTATTTGCACATGAACAGCCTGAGAGCCGATGACACGGCCGTATAT TACTGTGCGAAAGATGAGGCACCAGCTGGCGACATCTTTTTGACTC GCCCTTCCGTGTTCCCCCTGGCCCCCTGCAGCAGGAGCACCTCCGAA TCCACAGCTGCCCTGGGCTGTCTGTGAAGGACTACTTTCCCGAGCC CGTGACCGTGACCTGGAACAGCGGCGTCTGACATCCGGCGTCCACA CCTTTCCTGCCGTCCTAGTCTCTCCGGCACCAAGACCTACACCTG GTGGTGACCGTGCCTAGCTCCTCCCTGGCACCCAGGCACAAACGGGTCG TAACGTGACCAAAACCCTCCCTGCCCTCTGTCCTGCCCCGAGTTC AGAGCAAGTACGGCCCTCCAGCGTGTTCCTGTTCCTCTAAGCCCAAGGACAC CCTCATGATCAGCCGGACCACCCGAGGTGACCTGCGTGGTGGATG TGAGCCAGGAGGACCCTGAGGTCCAGTTCAACTGGTATGTGGATGGC GTGGAGTGCACAACGCCAAGACACAAAGCCCGGAAGAGCAGTTCAA CTCCACTTACAGGGTGGTCAGCGTGCTGACCGTGCTGCATCAGGACT GGCTGAACGGCAAGGAGTACAAGTGCAAGGTCAGCAATAAGGACTG CCCAGCAGCCATCGAGAAGACCATCTCCAAGGCTAAAGGCCAGCCCG GGAACCTCAGGTGTACACCCTGCCTCCGGTGAAGGATTCTACCCTTCC AGAACCAGGTGAGCCTGACCTGCCTGGTGAAGGGCTTCTACCCCTCC GACATCGCCGTGGAGTGGGAGTCCAACGGCCAGCCGGAGAACAATTA TAAGAACACCCCTCCCGTCCTGGATAGTGCAGGAGGCCCTGCACATCTTTCTGT ACTCCAGGCTGCTCCGTGATGCACGAGGCCCTGCACAATCACTACCCCA GAAGTCCCTGAGCCTGTCCCTGGGAAAG |
| 353 | Amino acid sequence of CDRL1 of 416E01 using IMGT | QGIRRW |
| 354 | Amino acid sequence of CDRL2 of 416E01 using IMGT | GAS |
| 355 | Amino acid sequence of CDRL3 of 416E01 using IMGT | QQANSFPIT |
| 356 | Amino acid sequence of CDRL1 of 416E01 using Kabat | RASQGIRRWLA |

TABLE S2-continued

SEQ ID NOS: 343-538

| | | | |
|---|---|---|---|
| 357 | 416E01-CDRL2 (Kabat) | Amino acid sequence of CDRL2 of 416E01 using Kabat | GASSLQS |
| 358 | 416E01-CDRL3 (Kabat) | Amino acid sequence of CDRL3 of 416E01 using Kabat | QQANSFPIT |
| 359 | 416E01-Light chain variable region (mutations from germline are shown in bold letters) | Amino acid sequence of V<sub>L</sub> of 416E01 | DIQMTQSPSSVSASVGDRVTITCRASQGIRRWLAWYQQKPGKAPKLL ISGASSLQSGVPSRFSGSGSGTDFTLIITSLQPEDFATYYCQQANSF PITFGQGTRLEIK |
| 360 | 416E01-Light chain variable region | Nucleic acid sequence of V<sub>L</sub> of 416E01 | GACATCCAGATGACCCAGTCTCCATCTTCCGTGTCTGCATCTGTAGG AGACAGAGTCACCATCACTTGTCGGGCCAGTCAGGGTATTAGGAGGT GGTTAGCCTGGTATCAGCAGAAACCAGGGAAAGCCCCTAAACTCCTG ATCTCTGGTGCATCCAGTTTGCAAAGTGGGGTCCATCAAGGTTCAG CGGCAGTGGATCTGGGACAGATTTCACTCTCATCATTACCAGTCTGC AGCCTGAAGATTTTGCAACTTACTATTGTCAACAGGCTAACAGTTTC CCGATCACCTTCGGCCAAGGGACACGACTGGAGATCAAAC |
| 361 | 416E01-full light chain sequence | Amino acid sequence of 416E01 light chain | DIQMTQSPSSVSASVGDRVTITCRASQGIRRWLAWYQQKPGKAPKLL ISGASSLQSGVPSRFSGSGSGTDFTLIITSLQPEDFATYYCQQANSF PITFGQGTRLEIKRTVAAPSVFIFPPSDEQLKSGTASVVCLLNNFYP REAKVQWKVDNALQSGNSQESVTEQDSKDSTYSLSSTLTLSKADYEK HKVYACEVTHQGLSSPVTKSFNRGEC |
| 362 | 416E01-full light chain sequence | Nucleic acid sequence of 416E01 light chain | GACATCCAGATGACCCAGTCTCCATCTTCCGTGTCTGCATCTGTAGG AGACAGAGTCACCATCACTTGTCGGGCCAGTCAGGGTATTAGGAGGT GGTTAGCCTGGTATCAGCAGAAACCAGGGAAAGCCCCTAAACTCCTG ATCTCTGGTGCATCCAGTTTGCAAAGTGGGGTCCATCAAGGTTCAG CGGCAGTGGATCTGGGACAGATTTCACTCTCATCATTACCAGTCTGC AGCCTGAAGATTTTGCAACTTACTATTGTCAACAGGCTAACAGTTTC CCGATCACCTTCGGCCAAGGGACACGACTGGAGATCAAACGTACGGT GGCTGCTCCCTCCGTTCATCTTCCCACCTTCCGACGAGCAGCTGA AGTCCGGCACCGCTTCTGTGTGCCTGCTGAACAACTTCTACCCC CGCGAGGCCAAGGTGCAGTGGAAGGTGGACAACGCTCCAGTCCGG CAACTCCCAGGAATCCGTGACCGAGCAGGACTCCAAGGACCACCT ACTCCCTGTCCTCCACCCTGCGAAGTGACCCACCACCAGCCAGAAG CACAAGGTGACGCCTGCGAAGTGACCCACCAGGGCCTCTGTCTAGCCC CGTGACCAAGTCTTTCAACCGGGGCGAGTGT |
| 363 | STIM001-CDRH1 | Amino acid sequence of CDRH1 of STIM001 using IMGT | GYTFSTFG |
| 364 | STIM001-CDRH2 | Amino acid sequence of CDRH2 of STIM001 using IMGT | ISAYNGDT |

TABLE S2-continued

SEQ ID NOS: 343-538

| | | | |
|---|---|---|---|
| 365 | STIM001-CDRH3 | Amino acid sequence of CDRH3 of STIM001 using IMGT | ARSSGHYYYGMDV |
| 366 | STIM001-Heavy chain variable region | Amino acid sequence of V$_H$ of STIM001 | QVQVVQSGAEVKKPGASVKVSCKASGYTFSTFGITWVRQAPGQGLEW MGWISAYNGDTNYAQNLQGRVIMTTDTSTAYMELRSLRSDDTAVY YCARSSGHYYYGMDVWGQGTTVTVSS |
| 367 | STIM001-Heavy chain variable region | Nucleic acid sequence of V$_H$ of STIM001 | CAGGTTCAGGTGGTGCAGTCTGGAGCTGAGGTGAAGAAGCCTGGGGC CTCAGTGAAGGTCTCCTGCAAGGCTTCTGGTTACACCTTTTCCACCT TTGGTATCACCTGGGTGCGACAGGCCCCTGGACAAGGGCTTGAATGG ATGGGATGGATCAGCGCTTACAATGGTGACACAAACTATGCACAGAA TCTCCAGGGCAGAGTCATCATGACCACAGACATCTCCACGGCCACAG CCTACATGGAGCTGAGGAGCCTGAGATCTGACGACACGGCCGTTTAT TACTGTGCGAGGAGCAGTGGCCACTACTACTACGGTATGGACGT CTGGGGCCAAGGGACCACGGTCACCGTCTCCTCA |
| 368 | STIM001-full heavy chain sequence | Amino acid sequence of STIM001 heavy chain | QVQVVQSGAEVKKPGASVKVSCKASGYTFSTFGITWVRQAPGQGLEW MGWISAYNGDTNYAQNLQGRVIMTTDTSTAYMELRSLRSDDTAVY YCARSSGHYYYGMDVWGQGTTVTVSSASTKGPSVFPLAPSSKSTSG GTAALGCLVKDYFPEPVTVSWNSGALTSGVHTFPAVLQSSGLYSLSS VVTVPSSSLGTQTYICNVNHKPSNTKVDKKVEPKSCDKTHTCPPCPA PELLGGPSVFLFPPKPKDTLMISRTPEVTCVVVDVSHEDPEVKFNWY VDGVEVHNAKTKPREEQYNSTYRVVSVLTVLHQDWLNGKEYKCKVSN KALPAPIEKTISKAKGQPREPQVYTLPPSRDELTKNQVSLTCLVKGF YPSDIAVEWESNGQPENNYKTTPPVLDSDGSFFLYSKLTVDKSRWQQ GNVFSCSVMHEALHNHYTQKSLSLSPGK |
| 369 | STIM001-full heavy chain sequence | Nucleic acid sequence of STIM001 heavy chain | CAGGTTCAGGTGGTGCAGTCTGGAGCTGAGGTGAAGAAGCCTGGGGC CTCAGTGAAGGTCTCCTGCAAGGCTTCTGGTTACACCTTTTCCACCT TTGGTATCACCTGGGTGCGACAGGCCCCTGGACAAGGGCTTGAATGG ATGGGATGGATCAGCGCTTACAATGGTGACACAAACTATGCACAGAA TCTCCAGGGCAGAGTCATCATGACCACAGACATCTCCACGGCCACAG CCTACATGGAGCTGAGGAGCCTGAGATCTGACGACACGGCCGTTTAT TACTGTGCGAGGAGCAGTGGCCACTACTACTACGGTATGGACGT CTGGGGCCAAGGGACCACGGTCACCGTCTCCTCAGCCAGTACCAAGG GCCCCTCTGTTCCCTGGGCTGCCTCGTGAAGGACTACTTCCCCGAGCC GGAACAGCCGTCTCCTGGAACTCTGGCGCTCTGACCAGCGGAGTGCACA CCTTCCCTGCTGTCCTGCAGTCCTCCGGACTCTACTCCCTGTCCTCC GTCGTGACCGTGCCTTCAGCTCTCTGGGCACCCAGACCTACATCTG CAACGTGAACCATAAGCCTCCAACACCAAGTGGACAAGAAGGTGG AACCCAAGTCCTGCGACAAGACCCACACCTGTCCCCCTTGTCCTGCC CCTGAACTGCTGGGCGGACCTTCCGTGTTCCTGTTCCCCCCAAAGCC CAAGGACACCCTGATGATCTCCCGGACCCCTGAAGTGACCTGCGTGG TGGTGGATGTGTCCCACGAAGTGCACAACGCCAAGACCAAGCCTAGA GAGGA ACAGTACAACTCCACCTACCGGGTGGTGTCCGTGCTGACCGTGCTGC ACCAGGATTGGCTGAACGGCAAGAGTACAAGTGCAAGGTGTCCAAC |

TABLE S2-continued

SEQ ID NOS: 343-538

| | | |
|---|---|---|
| 370 | STIM001-CDRL1 | Amino acid sequence of CDRL1 of STIM001 using IMGT |

AAGGCCCTGCCTGCCCCATCGAAAGACCATCTCCAAGGCCAAGG
CCAGCCCCGGAACCCAGGTGACACTGCCCCCTAGCAGGACG
AGCTGACCAAGAACCAGGTGTCCCTGACCTGTCTCGTGAAAGCTTC
TACCCCTCCGATATCGCCGTGAATGGGAGTCCAACGGCCAGCCTGA
GAACAACTACAAGACCACCCCCCCTGTCTGGACTCCGACGGCTCAT
TCTTCCTGTACAGCAAGCTGACAGTGGACAAGAGTCCCGTGGCAGCAG
GGCAACGTGTTCTCCTGCTCCGTGATGCACGAGGCCCTGCACAACCA
CTACACCCAGAAGTCCCTGTCCCTGAGCCCCGGCAAGTGATGA

QSLLHSNEYNY

| 371 | STIM001-CDRL2 | Amino acid sequence of CDRL2 of STIM001 using IMGT |

LGS

| 372 | STIM001-CDRL3 | Amino acid sequence of CDRL3 of STIM001 using IMGT |

MQSLQTPLT

| 373 | STIM001-Light chain variable region | Amino acid sequence of V$_L$ of STIM001 |

DIVMTQSPLSLPVTPGEPASISCRSSQSLLHSNEYNYLDWYLQKPGQ
SPQLLIFLGSNRASGVPDRFSGSGSGTDFTLKITRVEAEDVGIYYCM
QSLQTPLTFGGGTKVEIK

| 374 | STIM001-Light chain variable region | Nucleic acid sequence of V$_L$ of STIM001 |

GATATTGTGATGACTCAGTCTCCACTCTCCCTGCCCGTCACCCCTGG
AGAGCCGGCCTCCATCTGCAGGTCTGCAGTGTCAGTCTCCTGCATA
GTAATGAATACAACTATTTGGATTGGTACCTGCAGAAGCCAGGCAG
TCTCCACAGCTCCTGATCTTTTTGGGTTCTAATCGGGCCTCCGGGT
CCCTGACAGGTTCAGTGGCAGTGGATCAGGCACAGATTTTACACTGA
AAATCACCAGAGTGGAGGCTGAGGATGTTGGAATTTATTACTGCATG
CAATCTCTACAAACTCCGCTCACTTTCGGCGGAGGGACCAAGGTGGA
GATCAA

| 375 | STIM001-full light chain sequence | Amino acid sequence of STIM001 light chain |

DIVMTQSPLSLPVTPGEPASISCRSSQSLLHSNEYNYLDWYLQKPGQ
SPQLLIFLGSNRASGVPDRFSGSGSGTDFTLKITRVEAEDVGIYYCM
QSLQTPLTFGGGTKVEIK
RTVAAPSVFIFPPSDEQLKSGTASVVCLLNNFYPREAKVQWKVDNAL
QSGNSQESVTEQDSKDSTYSLSSTLTLSKADYEKHKVYACEVTHQGL
SSPVTKSFNRGEC

| 376 | STIM001-full light chain sequence | Nucleic acid sequence of STIM001 light chain |

GATATTGTGATGACTCAGTCTCCACTCTCCCTGCCCGTCACCCCTGG
AGAGCCGGCCTCCATCTGCAGGTCTGCAGTCTCCTGCATA
GTAATGAATACAACTATTTGGATTGGTACCTGCAGAAGCCAGGCCAG
TCTCCACAGCTCCTGATCTTTTTGGGTTCTAATCGGGCCTCCGGGT
CCCTGACAGGTTCAGTGGCAGTGGATCAGGCACAGATTTTACACTGA
AAATCACCAGAGTGGAGGCTGAGGATGTTGGAATTTATTACTGCATG
CAATCTCTACAAACTCCGCTCACTTTCGGCGGAGGGACCAAGGTGGA
GATCAAAcgtacggtggccgtcctcctccgtgttcatcttcccaccttt TABLE S2-continued

SEQ ID NOS: 343-538

| | | | |
|---|---|---|---|
| | | | ccgacgagcagctgaagtccggcaccgcttctgtcgtgcctgctg aacaacttctaccccgcgaggccaaggtgcagtggaaggtggacaa cgcctgcagtccgcaactccaggaatccgtgaccgagcaggact ccaaggacagcacctactccctgtcctccaccctgaccctgtccaag gccgactacgaggagcacaaggtacgcctgcgaagtgacccacca gggcctgtctagccccgtgaccaagtcttcaaccgggcgagtgt |
| 377 | STIM002-CDRH1 | Amino acid sequence of CDRH1 of STIM002 using IMGT | GYTFTSYG |
| 378 | STIM002-CDRH2 | Amino acid sequence of CDRH2 of STIM002 using IMGT | ISAYNGNT |
| 379 | STIM002-CDRH3 | Amino acid sequence of CDRH3 of STIM002 using IMGT | ARSTYFYGSGTLYGMDV |
| 380 | STIM002-Heavy chain variable region | Amino acid sequence of V$_H$ of STIM002 | QVQLVQSGGEVKKPGASVKVSCKASGYTFTSYGFSWVRQAPQGGLEW MGWISAYNGNTNYAQKLQGRVTMTTDTSTSTAYMELRSLRSDDTAVY YCARSTYFYGSGTLYGMDVWGQGTTVTVSS |
| 381 | STIM002-Heavy chain variable region | Nucleic acid sequence of V$_H$ of STIM002 | CAGGTTCAACTGGTGCAGTCTGGAGGTGAGGTGAAGAAGCCTGGGGC CTCAGTGAAGGTCTCCTGCAAGGCTTCTGGTTACACCTTTACCAGCT ATGGTTTCAGCTGGGTGCGACAGGCCCCTGGACAAGGACTAGAGTGG ATGGGATGGATCAGCGCTTACAATGGTAACACAAACTATGCACAGAA GCTCCAGGGCAGAGTCACCATGACCACAGACACATCCACGAGCACAG CCTACATGGAGCTGAGAGTCTAGTTCTATGGTTCGGGACCCTCTACGG TATGGACGTCTGGGGCCAAGGGACCACGGTCACCGTCTCCTCA |
| 382 | STIM002-full heavy chain sequence | Amino acid sequence of STIM002 heavy chain | QVQLVQSGGEVKKPGASVKVSCKASGYTFTSYGFSWVRQAPQGGLEW MGWISAYNGNTNYAQKLQGRVTMTTDTSTSTAYMELRSLRSDDTAVY YCARSTYFYGSGTLYGMDVWGQGTTVTVSSASTKGPSVFPLAPSSKS TSGGTAALGCLVKDYFPEPVTVSWNSGALTSGVHTFPAVLQSSGLYS LSSVVTVPSSSLGTQTYICNVNHKPSNTKVDKKVEPKSCDKTHTCPP CPAPELLGGPSVFLFPPKPKDTLMISRTPEVTCVVVDVSHEDPEVKF NWYVDGVEVHNAKTKPREEQYNSTYRVVSVLTVLHQDWLNGKEYKCK VSNKALPAPIEKTISKAKGQPREPQVYTLPPSRDELTKNQVSLTCLV KGFYPSDIAVEWESNGQPENNYKTTPPVLDSDGSFFLYSKLTVDKSR WQQGNVFSCSVMHEALHNHYTQKSLSLSPGK |
| 383 | STIM002-full heavy chain sequence | Nucleic acid sequence of STIM002 heavy chain | CAGGTTCAACTGGTGCAGTCTGGAGGTGAGGTGAAGAAGCCTGGGGC CTCAGTGAAGGTCTCCTGCAAGGCTTCTGGTTACACCTTTACCAGCT ATGGTTTCAGCTGGGTGCGACAGGCCCCTGGACAAGGACTAGAGTGG ATGGGATGGATCAGCGCTTACAATGGTAACACAAACTATGCACAGAA GCTCCAGGGCAGAGTCACCATGACCACAGACACATCCACGAGCACAG CCTACATGGAGCTGAGAGATCTTGAGATCTCACGACACCGGCCGTGTAT |

TABLE S2-continued

| | | SEQ ID NOS: 343-538 |
|---|---|---|
| | | TACTGTGCGAGATCTACGTATTTCTATGGTTCGGGAGACCCTCTACGG<br>TATGGACTCTGGGCCAAGGACCACGGTCACCGTCTCCTCA<br>GCCAGCACCAAGGGCCCCTCTGTTCCCCTCTGGCCCCTTCCAGCAA<br>GTCCACCTCTGGCGGAACAGCCGCTCTGGGCTGCCTCTGTGAAGGACT<br>ACTTCCCCGAGCCTGTGACCGTGTCCTGGAACTCGGGCTCTGACC<br>AGCGGAGTGCACACCTTCCCTGCTGTCCTGCAGTCTTCCGGCCTGTA<br>CTCCCTGTCCTCCGTGGTGACCGTGCCTTCCAGCTCTCTGGGCACCC<br>AGACCTACATCTGCAACGTGAACCACAAGCCTTCCAACACCAAGGTG<br>GACAAGAAGGTGGAACCCAAGTCTTGCGACAAGACCCACACCTGTCC<br>CCCTTGTCCTGCCCCTGAACTGCTGGGCGGACCCTCCGTGTTCCTGT<br>TCCCCCCAAAGCCCAAGGACACCCTGATGATTTCCCGGACCCCTGAAGTGAA<br>GTGACCTGCGTGGTGGACGTGTCCCACGAGGACCCTGAAGTGAA<br>GTTCAATTGGTACGTGGACGGCGTGGAAGTGCACAACGCCAAGACCA<br>AGCCTAGAGAGGAACAGTACAACTCCACCTACCGGGTGGTGTCCGTG<br>CTGACCGTGCTGCACCAGGATTGGCTGAACGGCAAGAGTACAAGTG<br>CAAGGTCCAACAAGGCCCTGCCTGCCCCCATCGAAAAGACCATCT<br>CCAAGGCCAAGGCCCAGCCCCGGGAACCCCAGGTGTACACACTGCCC<br>CCTAGCAGGGACGAGCTGACCAAGAACCAGGTGTCCCTGACCTGTCT<br>CGTGAAAGGCTTCTACCCCTCCGATATCGCCGTGGAATGGGAGTCCA<br>ACGGCCAGCCTGAGAACAACTACAAGACCACCCCCCTGTGCTGGAC<br>TCCGACGGCTCATTCTTCCTGTACAGCAAGCTGACAGTGGACAAGTC<br>CCGGTGGCAGCAGGGCAACGTGTTCTCTGCTCCGTGATGCACGAGG<br>CCCTGCACAACCACTACACCCAGAAGTCCCTGTCCCTGAGCCCCGGC<br>AAGTGATGA |
| 384 | Amino acid sequence<br>of CDRL1 of STIM002<br>using IMGT | QSLLHSDGYNY |
| 385 | Amino acid sequence<br>of CDRL2 of STIM002<br>using IMGT | LGS |
| 386 | Amino acid sequence<br>of CDRL3 of STIM002<br>using IMGT | MQALQTPLS |
| 387 | Amino acid sequence<br>of V$_L$ of STIM002 | DIVMTQSPLSLPVTPGEPASISCRSSQSLLHSDGYNYLDWYLQKPGQ<br>SPQLLIYLGSTRASGFPDRFSGSGSGTDFTLKISRVEAEDVGVYYCM<br>QALQTPLSFGQGTKLEIK |
| 388 | Nucleic acid<br>sequence of V$_L$ of<br>STIM002 | GATATTGTGATGACTCAGTCTCCACTCTCCCTGCCCGTCACCCCTGG<br>AGAGCCGGCCTCCATCTCCTGCAGGTCTAGTCAGAGCCTCCTGCATA<br>GTGATGGATACAACTGTTTGGATTGGTACCTGCAGAAGCCAGGGCAG<br>TCTCCACAGCTCCTGATCTATTTGGGTTCTACTCGGGCCTCCGGTT<br>CCCTGACAGGTTCAGTGGCAGTGGATCAGGCACAGATTTTACACTGA<br>AAATCAGCAGAGTGGAGGCTGAGGATGTTGGGGTTTATTACTGCATG<br>CAAGCTCTACAAACTCCGTGCAGTTTTGGCCAGGGGACCAAGCTGGA<br>GATCAA |

TABLE S2-continued

SEQ ID NOS: 343-538

| SEQ ID | Description | Sequence |
|---|---|---|
| 389 | Amino acid sequence of STIM002 light chain | DIVMTQSPLSLPVTPGEPASISCRSSQSLLHSDGYNYLDWYLQKPGQ SPQLLIYLGSTRASGFPDRFSGSGSGTDFTLKISRVEAEDVGVYYCM QALQTPLSFGQGTKLEIK RTVAAPSVFIFPPSDEQLKSGTASVVCLLNNFYPREAKVQWKVDNAL QSGNSQESVTEQDSKDSTYSLSSTLTLSKADYEKHKVYACEVTHQGL SSPVTKSFNRGEC |
| 390 | Nucleic acid sequence of STIM002 full light chain sequence | GATATTGTGATGACTCAGTCTCCACTCTCCCTGCCCGTCACCCTGG AGAGCCGGCCTCCATCTCCTGCAGGTCTAGTCAGAGCCTCCTGCATA GTGATGGATACAACTGTTTGGATTGGTACCTGCAGAAGCCAGGGCAG TCTCCACAGCTCCTGATCTATTTGGGTTCTACTCGGGCCTCCGGGTT CCCTGACAGGTTCAGTGCAGTGGATCAGGCACAGATTTTACACTGA AAATCAGCAGAGTGGAGGCTGAGGATGTTGGGGTTTATTACTGCATG CAAGCTCTACAAACTCCGTGCAGTTTTGGCCAGGGGACCAAGCTGGA GATCAAAcgtacggtggccgctccctccgtgttcatcttcccacctt ccgacgagcagctgaagtccggaactgcctctgttgtgtgcctgctg aacaacttctacccccgagagccaaggtgcagtggaaggtggacaa cgccctgcagtccggcaactcccaggactcgtgaccgaggact ccaaggacagcacctactccctgtcctccaccctgaccctgctgaa gccgactacgagaagcacaaagtgtacgcctgcgaagtgacccacca gggcctgctagccccgtgaccaagtctttcaaccgggcgagtgt |
| 391 | Amino acid sequence of CDRH1 of STIM002-B using IMGT | GYTFTSYG |
| 392 | Amino acid sequence of CDRH2 of STIM002-B using IMGT | ISAYNGNT |
| 393 | Amino acid sequence of CDRH3 of STIM002-B using IMGT | ARSTYFYGSGTLYGMDV |
| 394 | Amino acid sequence of V$_H$ of STIM002-B | QVQLVQSGGEVKKPGASVKVSCKASGYTFTSYGFSWVRQAPQGGLEW MGWISAYNGNTNVAQKLQGRVTMTTDTSTSTAYMELRSLRSDDTAVY YCARSTYFYGSGTLYGMDVWGQGTTVTVSS |
| 395 | Nucleic acid sequence of V$_H$ of STIM002-B | CAGGTTCAACTGGTGCAGTCTGGAGGTGAGGTGAAGAAGCCTGGGGC CTCAGTGAAGGTCTCCTGCAAGGCTTCTGGTTACACCTTTACCAGCT ATGGTTTCAGCTGGGTGCGACAGGCCCCTGGACAAGGACTAGAGTGG ATGGGATGGATCAGCGCTTACAATGGTAACACAAACTATGCACAGAA GCTCCAGGGCAGAGTCACCATGACCACAGACACATCCACGAGCACAG CCTACATGGAGCTGAGGAGCTTGAGATCTGAGACACGGCCGTGTAT TACTGTGCGAGATCTACCTATTTCTATGGTTCGGGGACCCTCTACGG TATGGACGTCTGGGGCCAAGGGACCACGGTCACCGTCTCCTCA |

| | | SEQ ID NOS: 343-538 |
|---|---|---|
| 396 | STIM002-B-full heavy chain sequence | Amino acid sequence of STIM002-B heavy chain | QVQLVQSGGEVKKPGASVKVSCKASGYTFTSYGFSWVRQAPGQGLEW MGWISAYNGNTNYAQKLQGRVTMTDTSTSTAYMELRSLRSDDTAVY YCARSTYFYGSGTLYGMDVWGQGTTVTVSSASTKGPSVFPLAPSSKS TSGGTAALGCLVKDYFPEPVTVSWNSGALTSGVHTFPAVLQSSGLYS LSSVVTVPSSSLGTQTYICNVNHKPSNTKVDKKVEPKSCDKTHTCPP CPAPELLGGPSVFLFPPKPKDTLMISRTPEVTCVVVDVSHEDPEVKF NWYVDGVEVHNAKTKPREEQYNSTYRVVSVLTVLHQDWLNGKEYKCK VSNKALPAPIEKTISKAKGQPREPQVYTLPPSRDELTKNQVSLTCLV KGFYPSDIAVEWESNGQPENNYKTTPPVLDSDGSFFLYSKLTVDKSR WQQGNVFSCSVMHEALHNHYTQKSLSLSPGK |
| 397 | STIM002-B-full heavy chain sequence | Nucleic acid sequence of STIM002-B heavy chain | CAGGTTCAACTGCTGCACTCTGCTGAGCTGAGCTGAAGAAGCCTCGGGC CTCAGTGAAGGTCTCCTGCAAGGCTTCTGCTTACACCTTTACCAGCT ATGGTTTCAGCTGGGTGCGACAGGCCCCTGGACAAGGACTAGAGTGG ATGGGATGGATCAGCGCTTACAATGGTAACACAAACTATGCACAGAA GCTCCAGGGCAGAGTCACCATGACCACAGACACATCCACGAGCACAG CCTACATGGAGCTGAGGAGCTTGAGATCTGAGATCGACACAGGCCGTGTAT TACTGTGCCAGAATCTACGTATTTCTATGGTTCGGGAGACCCTCTACGG TATGGACGTCTGGGGCCAAGGGACCACGGTCACCGTCTCCTCAGCCA GCACCAAGGGCCCCTCTGTGTTCCCCTGGCCCTGTCCAAGAGTCC ACCTCTGCCGAACAGCGCCCTCTGGGCTGCCTCTCGAAGGACTACTT CCCCGAGCCTGTGACCGTGTCCTGCTGTCCAGTCCTCCGCTCGGTACTCC GAGTGCACACCTTCCCTGCTGAGCGTGACGCTTCCAGCTCTCGGGCACCCAGAC CTACATCCAACGTGAACCACAAGCCCTCCAACACCAAGGTGACA AGAAGGTGAACCAAGTCCTGCGACAAGACCCACACCTCTGTTCCCCCT TGTCCTGCCCCTGAACTGCTGGGCCGACACCCTGATCTCCGGACCCCGAAGTGA CCTGCGTGGTGGTGGATGTGTCCCACGAGGACCCTGAAGTGAAGTTC AATGGTATGGTGACGCGTGGAAGTGCACAACGCCAAGACCAAGCC TAGAGAGGAACAGTACAACTCCACCTACCGGGTGGTGTCCGTGCTGA CCGTGCTGCACCAGGATTGGCTGAACGGCAAGAGTACAAGTGCAAG GTGTCCAACAAGGCCCTGCCTGCCCCATCGAAAAGACCATCTCCAA GGCCAAGGGCCAGCCCCGGAACCCAGTGTACACACTGCCCCTA GCAGGGACGAGCTTCTACCCCTCCGATATCGCCGTGGAATGGGAGTCAACGG AAAGGCTTCTACCCCTCCGATATCGCCGTGGAATGGGAGTCAACGG CCAGCCTCAACAACTACAAGACCACCCCCCCTGTGCTGGACTCCG ACGGCTCATTCTTCCTGTACAGCAAGCTGACAGTGGACAAGTCCGG TGGCAGCAGGGCAACGTGTTCTCCTGCTCCGTGATGCACGAGGCCCT GCACAACCACTACCACCCAGAAGTCCCTGTCCCTGAGCCCGGCAAGT GATGA |
| 398 | STIM002-B-CDRL1 | Amino acid sequence of CDRL1 of STIM002-B using IMGT | QSLLHSDGYNC |

TABLE S2-continued

SEQ ID NOS: 343-538

| | | | |
|---|---|---|---|
| 399 | STIM002-B-CDRL2 | Amino acid sequence of CDRL2 of STIM002-B using IMGT | LGS |
| 400 | STIM002-B-CDRL3 | Amino acid sequence of CDRL3 of STIM002-B using IMGT | MQALQTPCS |
| 401 | STIM002-B-Light chain variable region | Amino acid sequence of V<sub>L</sub> of STIM002-B | DIVMTQSPLSLPVTPGEPASISCRSSQSLLHSDGYNCLDWYLQKPGQ SPQLLIYLGSTRASGFPDRFSGSGSGTDFTLKISRVEAEDVGVYYCM QALQTPCSFGQGTKLEIK |
| 402 | STIM002-B-Light chain variable region | Nucleic acid sequence of V<sub>L</sub> of STIM002-B | GATATTGTGATGACTCAGTCTCCACTCTCCCTGCCCGTCACCCCTGG AGAGCCGGCCTCCATCTCCTGCAGGTCTAGTCAGAGCCTCCTGCATA GTGATGGATACAACTGTTTGGATTGGTACCTGCAGAAGCCAGGGCAG TCTCCACAGCTCCTGATCTATTTGGGTTCTACTCGGGCCTCCGGGTT CCCTGACAGGTTCAGTGGCAGTGGATCAGGCACAGATTTTACACTGA AAATCAGCAGAGTGGAGGCTGAGGATGTTGGGGTTTATTACTGCATG CAAGCTCTACAAACTCCGTGCAGTTTTGGCCAGGGGACCAAGCTGGA GATCAA |
| 403 | STIM002-B-full light chain sequence | Amino acid sequence of STIM002-B light chain | DIVMTQSPLSLPVTPGEPASISCRSSQSLLHSDGYNCLDWYLQKPGQ SPQLLIYLGSTRASGFPDRFSGSGSGTDFTLKISRVEAEDVGVYYCM QALQTPCSFGQGTKLEIK RTVAAPSVFIFPPSDEQLKSGTASVVCLLNNFYPREAKVQWKVDNAL QSGNSQESVTEQDSKDSTYSLSSTLTLSKADYEKHKVYACEVTHQGL SSPVTKSFNRGEC |
| 404 | STIM002-B-full light chain sequence | Nucleic acid sequence of STIM002-B light chain | GATATTGTGATGACTCAGTCTCCACTCTCCCTGCCCGTCACCCCTGG AGAGCCGGCCTCCATCTCCTGCAGGTCTAGTCAGAGCCTCCTGCATA GTGATGGATACAACTGTTTGGATTGGTACCTGCAGAAGCCAGGGCAG TCTCCACAGCTCCTGATCTATTTGGGTTCTACTCGGGCCTCCGGGTT CCCTGACAGGTTCAGTGGCAGTGGATCAGGCACAGATTTTACACTGA AAATCAGCAGAGTGGAGGCTGAGGATGTTGGGGTTTATTACTGCATG CAAGCTCTACAAACTCCGTGCAGTTTTGGCCAGGGGACCAAGCTGGA GATCAAacgtacggtggccgctccatctcttcccactt ccgagcagcagcctgaagctcgaactcccccgaggccaagtcgacagtggaaggtgacaa ccaaggacagcacctacctcctgtccagcaccctgacgctgagcaaa ggcgacttacgagaagcacaaggtgtacgcctgcgaagtgacccacca gggcctgtcctagccccgtgaccaagtctttcaaccgggggagtgt |
| 405 | STIM003-CDRH1 | Amino acid sequence of CDRH1 of STIM003 using IMGT | GVTFDDYG |
| 406 | STIM003-CDRH2 | Amino acid sequence of CDRH2 of STIM003 using IMGT | INWNGGDT |

TABLE S2-continued

SEQ ID NOS: 343-538

| | | |
|---|---|---|
| 407 | STIM003-CDRH3 | Amino acid sequence of CDRH3 of STIM003 using IMGT |

ARDFYGSSYYHVPFDY

| | | |
|---|---|---|
| 408 | STIM003-Heavy chain variable region | Amino acid sequence of V$_H$ of STIM003 |

EVQLVESGGGVVRPGGSLRLSCVASGVTFDDYGMSWVRQAPGKGLEW
VSGINWNGGDTDYSDSVKGRFTISRDNAKNSLYLQMNSLRAEDTALY
YCARDFYGSSYYHVPFDYWGQGILVTVSS

| | | |
|---|---|---|
| 409 | STIM003-Heavy chain variable region | Nucleic acid sequence of V$_H$ of STIM003 |

GAGGTGCAGCTGGTGGAGTCTGGGGGAGGTGTGGTACGGCCTGGGGG
GTCCCTGAGACTCTCCTGTGCAGCCTCTGGAGTCACCTTTGATGATT
ATGGCATGAGCTGGGTCCGCCAAGCTCCAGGGAAGGGGCTGGARTGG
GTCTCTGGTATTAATTGGAATGGTGGCACACAGATTATTCAGACTC
TGTGAAGGGCCGATTCACCATCTCCAGAGACAACGCCAAGAACTCCC
TGTATCTACAAATGAATAGTCTGAGAGCCGAGGACACGGCCTTGTAT
TACTGTGCCAGGGATTTCTATGGTTCGGGGAGTTATTACACGTTCC
TTTTGACTACTGGGGCCAGGGAATCCTGGTCACCGTCTCCTCA

| | | |
|---|---|---|
| 410 | STIM003-full heavy chain sequence | Amino acid sequence of STIM003 heavy chain |

EVQLVESGGGVVRPGGSLRLSCVASGVTFDDYGMSWVRQAPGKGLEW
VSGINWNGGDTDYSDSVKGRFTISRDNAKNSLYLQMNSLRAEDTALY
YCARDFYGSSYYHVPFDYWGQGILVTVSSASTKGPSVFPLAPSSKS
TSGGTAALGCLVKDYFPEPVTVSWNSGALTSGVHTFPAVLQSSGLYS
LSSVVTVPSSSLGTQTYICNVNHKPSNTKVDKKVEPKSCDKTHTCPP
CPAPELLGGPSVFLFPPKPKDTLMISRTPEVTCVVVDVSHEDPEVKF
NWYVDGVEVHNAKTKPREEQYNSTYRVVSVLTVLHQDWLNGKEYKCK
VSNKALPAPIEKTISKAKGQPREPQVYTLPPSRDELTKNQVSLTCLV
KGFYPSDIAVEWESNGQPENNYKTTPPVLDSDGSFFLYSKLTVDKSR
WQQGNVFSCSVMHEALHNHYTQKSLSLSPGK

| | | |
|---|---|---|
| 411 | STIM003-full heavy chain sequence | Nucleic acid sequence of STIM003 heavy chain |

GAGGTGCAGCTGGTGGAGTCTGGGGGAGGTGTTGGTACGGCCTGGGGG
GTCCCTGAGACTCTCCTGTGTAGCCTCTGGAGTCACCTTTGATGATT
ATGGCATGAGCTGGGTCCGCCAAGCTCCAGGGAAGGGGCTGGARTGG
GTCTCTGGTATTAATTGGAATGGTGGCACACAGATTATTCAGACTC
TGTGAAGGGCCGATTCACCATCTCCAGAGACAACGCCAAGAACTCCC
TGTATCTACAAATGAATAGTCTGAGAGCCGAGGACACGGCCTTGTAT
TACTGTGCCAGGGATTTCTATGGTTCGGGGAGTTATTACACGTTCC
TTTTGACTACTGGGGCCAGGGAATCCTGGTCACCGTCTCCTCAGCCA
GCACCAAGGGCCCCTCTGTCTTCCCCTGGCCCCTCTGCTCCAAGTCC
ACCTCTGGCGGAACAGCCCGCTGTCCTGGAACTCTGGCGCTCTGACCAGCG
GAGTGCACACCTTCCCTGCACCGTCGTGCTGCTTCCAGCTCCGGCCTGTACTCC
CTGTCCTCCGTGGTCACCGTGCCCTCCAGCTCTGGCACCCAGACC
CTACATCTGCAACGTGAACCACAAGCCCTCCAACACCAAGGTGGACA
AGAAGGTGGAACCCAAGTCCTGCGACAAGACCCACACCTGTCCCCCT
TGTCCTGCCCCTGAACTGCTGGCGGACCCTGAGCTCCCGACCTCGTTCCC
CCCAAAGCCAAGGACACCCTGATGATCTCCAGGACCCCTGAAGTGA
CCTGCGTGGTGGTGGATGTGTCCACCGAGGACCCTGAAGTGAAGTTC
AATTGGTACGTGGACGGCGTGAAGTGCACAACGCCAAGACCAAGCC
TAGAGAGGAACAGTACAACTCCACCTACCGGGTGGTGTCCGTGCTGA

TABLE S2-continued

SEQ ID NOS: 343-538

| | | |
|---|---|---|
| 412 | STIM003-CDRL1 | Amino acid sequence of CDRL1 of STIM003 using IMGT | CCGTGCTCGCCAGGATTGGCTGAACGGCAAAGATACAAGTCAAG GTGTCCAACAAGGGCCCTGCCTGCCCCATCGAAAAGACCATCTCCAA GGCCAAGGGCCAGCCCGGGAACCCCAGGTGTACACACTGCCCCCTA GCAGGGACGAGCTGACCAAGAACCAGGTGTCCCTGACCTGTCTGTG AAAGGCTTCTACCCCTCCGATATCGCCGTGGAATGGGAGTCAACGG CCAGCCTGAGAACAACTACAAGACCACCCCCCCTGTCGCTGACTCCG ACGGCTCATTCTTCCTGTACAGCAAGCTGACAGTGGACAAGTCCGG TGGCAGCAGGGCAACGTGTTCTCCTGCTCCGTGATGCACGAGGCCT GCACAACTACACCCAGAAGTCCCTGTCCCTGAGCCCGGCAAGT GATGA |

| 412 | | | |
| 413 | STIM003-CDRL1 | Amino acid sequence of CDRL1 of STIM003 using IMGT | QSVSRSY |
| 413 | STIM003-CDRL2 | Amino acid sequence of CDRL2 of STIM003 using IMGT | GAS |
| 414 | STIM003-CDRL3 | Amino acid sequence of CDRL3 of STIM003 using IMGT | HQYDMSPFT |
| 415 | STIM003-Light chain variable region | Amino acid sequence of V$_L$ of STIM003 | EIVLTQSPGTLSLSPGERATLSCRASQSVSRSYLAWYQQKRQAPRL LIYGASSRATGIPDRFSGDSGTDFTLSISRLEPEDFAVYYCHQYDM SPFTFGPGTKVDIK |
| 416 | STIM003-Light chain variable region | Nucleic acid sequence of V$_L$ of STIM003 | GAAATTGTGTTGACGCAGTCTCCAGGGACCCTGTCTTTGTCTCCAGG GGAAAGAGCCACCCTCTCCTGCAGGGCCAGTCAGAGTGTTAGCAGAA GCTACTTAGCCTGGTACCAGCAGAAACGTGGCCAGGCTCCCAGGCTC CTCATCTATGGTGCATCCAGCAGGGCCACTGGCATCCCAGACAGGTT CAGTGGCGATGGGTCTGGGACAGACTTCACTCTCTCCATCAGCAGAC TGGAGCCTGAAGATTTTGCAGTGTATTACTGTCACCAGTATGATATG TCACCATTCACTTTCGGCCCTGGGACCAAAGTGGATATCAAA |
| 417 | STIM003-full light chain sequence | Amino acid sequence of STIM003 light chain | EIVLTQSPGTLSLSPGERATLSCRASQSVSRSYLAWYQQKRQAPRL LIYGASSRATGIPDRFSGDSGTDFTLSISRLEPEDFAVYYCHQYDM SPFTFGPGTKVDIKRTVAAPSVFIFPPSDEQLKSGTASVVCLLNNFY PREAKVQWKVDNALQSGNSQESVTEQDSKDSTYSLSSTLTLSKADYE KHKVYACEVTHQGLSSPVTKSFNRGEC |
| 418 | STIM003-full light chain sequence | Nucleic acid sequence of STIM003 light chain | GAAATTGTGTTGACGCAGTCTCCAGGGACCCTGTCTTTGTCTCCAGG GGAAAGAGCCACCCTCTCCTGCAGGGCCAGTCAGAGTGTTAGCAGAA GCTACTTAGCCTGGTACCAGCAGAAACGTGGCCAGGCTCCCAGGCTC CTCATCTATGGTGCATCCAGCAGGGCCACTGGCATCCCAGACAGGTT CAGTGGCGATGGGTCTGGGACAGACTTCACTCTCTCCATCAGCAGAC TGGAGCCTGAAGATTTTGCAGTGTATTACTGTCACCAGTATGATATG TCACCATTCACTTTCGGCCCTGGGACCAAAGTGGATATCAAAcgtac ggtggccgctccctccgtgttcatcttcccaccttccgacgagcagc |

TABLE S2-continued

| | | SEQ ID NOS: 343-538 |
|---|---|---|
| | | tgaagtccggcaccgcttctgtcgtgctgctgaacaacttctac ccccgcgaggccaaggtgcagtggaaggtggacaacgccctgcagtc cggcaactcccaggaatccgtgaccgagcaggactccaaggacagca cctactccctgtcctccaccctgaccctgtccaaggccgactacgag aagcacaaggtgtacgcctgcgaagtgacccaccaggccctgctag cccgtgaccaagtctttcaaccggggcgagtgt |
| 419 | STIM004-CDRH1 | Amino acid sequence of CDRH1 of STIM004 using IMGT GLTFDDYG |
| 420 | STIM004-CDRH2 | Amino acid sequence of CDRH2 of STIM004 using IMGT INWNGDNT |
| 421 | STIM004-CDRH3 | Amino acid sequence of CDRH3 of STIM004 using IMGT ARDYYGSGSYYNVPFDY |
| 422 | STIM004-Heavy chain variable region | Amino acid sequence of V_H of STIM004 EVQLVESGGGVVRPGGSLRLSCAASGLTFDDYGMSWVRQVPGKGLEW VSGINWNGDNTDYADSVKGRFTISRDNAKNSLYLQMNSLRAEDTALY YCARDYYGSGSYYNVPFDYWGQGTLVTVSS |
| 423 | STIM004-Heavy chain variable region | Nucleic acid sequence of V_H of STIM004 GAGGTGCAGCTGGTGGAGTCTGGGGGAGGTGTGGACTTGATGATT ATGGCATGAGCTGGGTCCGCCAAGTTCCAGGGAAGGGGCTGGAGTGG GTCTCTGGTATTAATTGGAATGGTGATAACACAGATTATGCAGACTC TGTGAAGGGCCGATTCACCATCTCCAGAGACAACGCCAAGAACTCC TGTATCTGCAAATGAACAGTCTGAGAGCCGAGGACACGGCCTTGTAT TACTGTGCGAGGGATTACTATGGTTCGGGAGTTATTATAACGTTCC TTTTGACTACTGGGGCCAGGGAACCCTGGTCACCGTCTCCTCA |
| 424 | STIM004-full heavy chain sequence | Amino acid sequence of STIM004 heavy chain EVQLVESGGGVVRPGGSLRLSCAASGLTFDDYGMSWVRQVPGKGLEW VSGINWNGDNTDYADSVKGRFTISRDNAKNSLYLQMNSLRAEDTALY YCARDYYGSGSYYNVPFDYWGQGTLVTVSSASTKGPSVFPLAPSSKS TSGGTAALGCLVKDYFPEPVTVSWNSGALTSGVHTFPAVLQSSGLYS LSSVVTVPSSSLGTQTYICNVNHKPSNTKVDKKVEPKSCDKTHTCPP CPAPELLGGPSVFLFPPKPKDTLMISRTPEVTCVVVDVSHEDPEVKF NWYVDGVEVHNAKTKPREEQYNSTYRVVSVLTVLHQDWLNGKEYKCK VSNKALPAPIEKTISKAKGQPREPQVYTLPPSRDELTKNQVSLTCLV KGFYPSDIAVEWESNGQPENNYKTTPPVLDSDGSFFLYSKLTVDKSR WQQGNVFSCSVMHEALHNHYTQKSLSLSPGK |
| 425 | STIM004-full heavy chain sequence | Nucleic acid sequence of STIM004 heavy chain GAGGTGCAGCTGGTGGAGTCTGGGGGAGGTGTGGACTTGATGATT ATGGCATGAGCTGGGTCCGCCAAGTTCCAGGGAAGGGGCTGGAGTGG GTCTCTGGTATTAATTGGAATGGTGATAACACAGATTATGCAGACTC TGTGAAGGGCCGATTCACCATCTCCAGAGACAACGCCAAGAACTCCC TGTATCTGCAAATGAACAGTCTGAGAGCCGAGGACACGGCCTTGTAT |

TABLE S2-continued

SEQ ID NOS: 343-538

| | | |
|---|---|---|
| | | TACTGTGCGAGGGATTACTATGTTCGGGAGTTATTATAACGTTCC<br>TTTTCACTACTGGGGCCAGGGAACCCTGGTCACCGTCTCCTCAGCCA<br>GCACCAAGGGCCCCTCTGTGTTCCCTCTGGCCCCTCCAGCAAGTCC<br>ACCTCTGGCGAACAGCCGCTCTGGGCTGCCTCGTGAAGGACTACTT<br>CCCCGAGCCTGTGACCGTGTCCTGGAACTCTGGCGCTCTGACCAGCG<br>GAGTGCACACCTTCCCTGCTGTGCTGCAGTCTCCGGCCTGTACTCC<br>CTGTCCTCCGTCGTGACCGTGCCTTCCAGCTCTGGGCACCCAGAC<br>CTACATCTGCAACGTGAACCACAAGCCCTCCAACACCAAGGTGGACA<br>AGAAGGTGGAACCCAAGTCCTGCGACAAGACCCACACCTGTCCCCT<br>TGTCCTGCCCCTGAACTGCTGGGCGGACCCTCCGTGTTCCTGTTCCC<br>CCCAAAGCCCAAGGACACACCCTGATGATCTCCAGGACCCCTGAAGTGA<br>CCTGCGTGGTGGTGGATGTGTCCCACGAGGACCCTGAAGTGAAGTTC<br>AATTGGTACGTGGACGGCGTGGAAGTGCACAACGCCAAGACCAAGCC<br>TAGAGAGGAACAGTACAACTCCACCTACCGGGTGGTGTCCGTGCTGA<br>CCGTGCTGCACCAGGATTGGCTGAACGGCAAAGAGTACAAGTGCAAG<br>GTGTCCAACAAGGCCCTGCCTGCCCCATCGAAAAGACCATCTCCAA<br>GGCCAAGGGCCAGCCCCGGGAACCCCAGGTGTACACACTGCCCCCTA<br>GCAGGGACGAGCTGACCAAGAACCAGGTGTCCCTGACCTGTCTCGTG<br>AAAGGCTTCTACCCCTCCGATATCGCCGTGGAATGGGAGTCCAACGG<br>CCAGCCTGAGAACAACTACAAGACCACCCCCCTGTGCTGGACTCCG<br>ACGGCTCATTCTTCCTGTACAGCAAGCTGACAGTGGACAAGTCCGG<br>TGGCAGCAGGGCAAGTGTTCTCCTGCTCCGTGATGCACGAGGCCCT<br>GCACAACCACTACACCCAGAAGTCCCTGTCCCTGAGCCCGGCAAGT<br>GATGA | |
| 426 | STIM004-<br>CDRL1<br>Amino acid sequence<br>of CDRL1 of STIM004<br>using IMGT | QSVSSSY |
| 427 | STIM004-<br>CDRL2<br>Amino acid sequence<br>of CDRL2 of STIM004<br>using IMGT | GAS |
| 428 | STIM004-<br>CDRL3<br>Amino acid sequence<br>of CDRL3 of STIM004<br>using IMGT | QQYGSSPF |
| 429 | STIM004-<br>Corrected<br>light<br>chain<br>variable<br>region<br>Amino acid sequence<br>of corrected $V_L$ of<br>STIM004 | EIVLTQSPGTLSLSPGERATLSCRASQSVSSSYLAWYQQKPGQAPRL<br>LIYGASSRATGIPDRFSGSGSGTDFTLTIRRLEPEDFAVYYCQQYGS<br>SPFFGPGTKVDIK |
| 430 | STIM004-<br>Corrected<br>light<br>chain<br>variable<br>region<br>Nucleic acid<br>sequence of<br>corrected $V_L$ of<br>STIM004 | GAAATTGTGTTGACGCAGTCTCCAGGCACCCTGTCTTTGTCTCCAGG<br>GGAAAGAGCCACCCTCTCCTGCAGGGCCAGTCAGAGTGTTAGCAGCA<br>GCTACTTAGCCTGGTACCAGCAGAAACCTGGCCAGGCTCCCAGGCTC<br>CTCATATATGGTGCATCCAGCAGGGCCACTGGCATCCCAGACAGGTT<br>CAGTGGCAGTGGGTCTGGGACAGACTTCACTCTCACCATCAGAAGAC<br>TGGAGCCTGAAGATTTTGCAGTGTATTACTGTCAGCAGTATGGTAGT<br>TCACCATTCTTCGGCCCTGGGACCAAGTTGGATATCAAA |

TABLE S2-continued

SEQ ID NOS: 343-538

| | | | |
|---|---|---|---|
| 431 | STIM004-Light chain variable region of STIM004 | Nucleic acid sequence of V$_L$ of STIM004 | GAAATTGTGTTGACGCAGTCTCCAGGCACCCTGTCTTTGTCTCCAGG<br>GGAAAGAGCCACCCTCTCCTGCAGGGCCAGTCAGAGTGTTAGCAGCA<br>GCTACTTAGCCTGGTACCAGCAGAAACCTGGCCAGGCTCCCAGGCTC<br>CTCATATATGGTGCATCCAGCAGGGCCACTGGCATCCCAGACAGGTT<br>CAGTGGCAGTGGGTCTGGGACAGACTTCACTCTCACCATCAGAAGAC<br>TGGAGCCTGAAGATTTTGCAGTGTATTACTGTCAGCAGTATGGTAGT<br>TCACCATTCACTTCGGCCCTGGGACCAAAGTGGATATCAAA |
| 432 | STIM004-full corrected light chain sequence | Amino acid sequence of STIM004 light chain | EIVLTQSPGTLSLSPGERATLSCRASQSVSSSYLAWYQQKPGQAPRL<br>LIYGASSRATGIPDRFSGSGSGTDFTLTIRRLEPEDFAVYYCQQYGS<br>SPFFGPGTKVDIKRTVAAPSVFIFPPSDEQLKSGTASVVCLLNNFYP<br>REAKVQWKVDNALQSGNSQESVTEQDSKDSTYSLSSTLTLSKADYEK<br>HKVYACEVTHQGLSSPVTKSFNRGEC |
| 433 | STIM004-full corrected light chain sequence | Nucleic acid sequence of corrected STIM004 light chain | GAAATTGTGTTGACGCAGTCTCCAGGCACCCTGTCTTTGTCTCCAGG<br>GGAAAGAGCCACCCTCTCCTGCAGGGCCAGTCAGAGTGTTAGCAGCA<br>GCTACTTAGCCTGGTACCAGCAGAAACCTGGCCAGGCTCCCAGGCTC<br>CTCATATATGGTGCATCCAGCAGGGCCACTGGCATCCCAGACAGGTT<br>CAGTGGCAGTGGGTCTGGGACAGACTTCACTCTCACCATCAGAGAC<br>TGGAGCCTGAAGATTTTGCAGTGTATTACTGTCAGCAGTATGGTAGT<br>TCACCATTCTTCGGCCCTGGGACCAAAGTGGATATCAAAcgtacggt<br>ggccgcatctgtcttcatcttcccaccttccgacgagcagctga<br>agtccggaaccgcctcctgtgtgcctgctgaacaacttctacccc<br>cgcgaggccaaggtgcagtggaaggtggacaacgccctgcagtccgg<br>caactcccaggaatccgtgaccgagcaggactccaaggacagcacct<br>actcctgtctccacctgaccctgcgaagtgacccaccagagaag<br>cacaaggtgtacgcctgcgaagtgacccaccagggcctctagccc<br>cgtgaccaagtccttcaaccggggcgagtgt |
| 434 | STIM004-full corrected light chain sequence | Nucleic acid sequence of STIM004 light chain | GAAATTGTGTTGACGCAGTCTCCAGGCACCCTGTCTTTGTCTCCAGG<br>GGAAAGAGCCACCCTCTCCTGCAGGGCCAGTCAGAGTGTTAGCAGCA<br>GCTACTTAGCCTGGTACCAGCAGAAACCTGGCCAGGCTCCCAGGCTC<br>CTCATATATGGTGCATCCAGCAGGGCCACTGGCATCCCAGACAGGTT<br>CAGTGGCAGTGGGTCTGGGACAGACTTCACTCTCACCATCAGAAGAC<br>TGGAGCCTGAAGATTTTGCAGTGTATTACTGTCAGCAGTATGGTAGT<br>TCACCATTCACTTCGGCCCTGGGACCAAAGTGGATATCAAActacg<br>gtggccgcatctgtcttcatcttcccaccttccgacgagcagct<br>gaagtccggaaccgcctctgtgtgcctgctgaacaacgccctcgtcc<br>ccgcgaggccaaggtgcagtggaaggtggacaacgccctgcagtcc<br>ggcaactcccaggaatccgtgaccgagcaggactccaaggacagcac<br>ctactcctgtctccacctgaccctgcgaaggcgactacga<br>agcacaaggtgtacgcctgcgaagtgacccaccaaggctctagc<br>ccgtgaccaagtccttcaaccggggcgagtgt |
| 435 | STIM005-CDRH1 | Amino acid sequence of CDRH1 of STIM005 using IMGT | GYTFNSYG |

TABLE S2-continued

| | | SEQ ID NOS: 343-538 | |
|---|---|---|---|
| 436 | STIM005-CDRH2 | Amino acid sequence of CDRH2 of STIM005 using IMGT | ISVHNGNT |
| 437 | STIM005-CDRH3 | Amino acid sequence of CDRH3 of STIM005 using IMGT | ARAGYDILTDFSDAFDI |
| 438 | STIM005-Heavy chain variable region | Amino acid sequence of V<sub>H</sub> of STIM005 | QVQLVQSGAEVKKPGASVKVSCKASGYTFNSYGIIWVRQAPGQGLEW<br>MGWISVHNGNTNCAQKLQGRVTMTTDTSTSTAYMELRSLRTDDTAVY<br>YCARAGYDILTDFSDAFDIWGHGTMVTVSS |
| 439 | STIM005-Heavy chain variable region | Nucleic acid sequence of V<sub>H</sub> of STIM005 | CAGGTTCAGTTGGTGCAGTCTGGAGCTGAGGTGAAGAAGCCTGGGGC<br>CTCAGTGAAGGTCTCCTGCAAGGCTTCTGGTTACACCTTTAATAGTT<br>ATGGTATCATCTGGGTGCGACAGGCCCCTGGACAAGGGCTTGAGTGG<br>ATGGGATGGATCAGCGTTCACAATGGTAACACAAACTGTGCACAGAA<br>GCTCCAGGGTAGAGTCACCATGACCACAGACACATCCACGAGCACAG<br>CCTACATGGAGCTGAGGAGCCTGAGAACTGACGACACGGCCGTGTAT<br>TACTGTGCGAGAGCGGGTTACGATATTTTGACTGATTTTTCCGATGC<br>TTTTGATATCTGGGGCCACGGGACAATGGTCACCGTCTCTTCA |
| 440 | STIM005-full heavy chain sequence | Amino acid sequence of STIM005 heavy chain | QVQLVQSGAEVKKPGASVKVSCKASGYTFNSYGIIWVRQAPGQGLEW<br>MGWISVHNGNTNCAQKLQGRVTMTTDTSTSTAYMELRSLRTDDTAVY<br>YCARAGYDILTDFSDAFDIWGHGTMVTVSSASTKGPSVFPLAPSSKS<br>TSGGTAALGCLVKDYFPEPVTVSWNSGALTSGVHTFPAVLQSSGLYS<br>LSSVVTVPSSSLGTQTYICNVNHKPSNTKVDKKVEPKSCDKTHTCPP<br>CPAPELLGGPSVFLFPPKPKDTLMISRTPEVTCVVVDVSHEDPEVKF<br>NWYVDGVEVHNAKTKPREEQYNSTYRVVSVLTVLHQDWLNGKEYKCK<br>VSNKALPAPIEKTISKAKGQPREPQVYTLPPSRDELTKNQVSLTCLV<br>KGFYPSDIAVEWESNGQPENNYKTTPPVLDSDGSFFLYSKLTVDKSR<br>WQQGNVFSCSVMHEALHNHYTQKSLSLSPGK |
| 441 | STIM005-full heavy chain sequence | Nucleic acid sequence of STIM005 heavy chain | CAGGTTCAGTTGGTGCAGTCTGGAGCTGAGGTGAAGAAGCCTGGGGC<br>CTCAGTGAAGGTCTCCTGCAAGGCTTCTGGTTACACCTTTAATAGTT<br>ATGGTATCATCTGGGTGCGACAGGCCCCTGGACAAGGGCTTGAGTGG<br>ATGGGATGGATCAGCGTTCACAATGGTAACACAAACTGTGCACAGAA<br>GCTCCAGGGTAGAGTCACCATGACCACAGACACATCCACGAGCACAG<br>CCTACATGGAGCTGAGGAGCCTGAGAACTGACGACACGGCCGTGTAT<br>TACTGTGCGAGAGCGGGTTACGATATTTTGACTGATTTTTCCGATGC<br>TTTTGATATCTGGGGCCACGGGACAATGGTCACCGTCTCTTCA<br>GCCAGCACCAAGGGCCCCTCTGTTCCCCTCTGGCCTCCTGTCAGCAA<br>GTCCACTCTGCGCAGAACAGCCGCTCTGGCGCCGCCTTGTCTGAAGGACT<br>ACTTCCCCGAGCCTGTGACCGTGTCCTGGAACTCTGGCGCTCTGACC<br>AGCGGAGTGCACACCTTCCCTGCTGTCCTGCAGTCCTCCGGCCTGTA<br>CTCCCTGTCCTCCGTGGTGACCGTGCCTTCCAGCTCTCTGGGCACCC<br>AGACCTACATCTGCAACGTGAACCACAAGCCCTCCAACACCAAGGTG<br>GACAAGAAGGTGGAACCCAAGTCCTGCGACAAGACCCACACCTGTCC<br>CCCTTGTCCCCCTGAACTGCTGGGCGGACCTTCCGTGTTCCTGT<br>TCCCCCCAAGCCCAAGGACACCCTGATGATCTCCCGGACCCCCGAA |

TABLE S2-continued

SEQ ID NOS: 343-538

| | | | |
|---|---|---|---|
| | | | GTGACCTGCGTGGTGTGGATGTGTCCCAGAGGACCCTGAAGTGAA<br>GTTCAATTGGTACGTGGACGGCGTGGAAGTGCACAACGCCAGACCA<br>AGCCTAGAGAGGAACAGTACAACTCCACCTACCGGGTGGTGTCCGTG<br>CTGACCGTGCTGCACCAGGATTGGCTGAACGGCAAAGAGTACAAGTG<br>CAAGGTGTCCAACAAGGCCCTGCCTGCCCCCATCGAAAAGACCATCT<br>CCAAGGCCAAGGGCCAGCCCCGGGAACCCCAGGTGTACACACTGCCC<br>CCTAGCAGGGACGAGCTGACCAAGAACCAGGTGTCCCTGACCTGTCT<br>CGTGAAAGGCTTCTACCCTAGCGATATCGCCGTGGAATGGGAGTCCA<br>ACGGCCAGCCTGAGAACAACTACAAGACCACCCCCCCTGTGCTGGAC<br>TCCGACGGCTCATTCTTCCTGTACAGCAAGCTGACAGTGGACAAGTC<br>CCGGTGGCAGCAGGGCAACGTGTTCTCCTGCTCCGTGATGCACGAGG<br>CCCTGCACAACCACTACACCCAGAAGTCCCTGTCCCTGAGCCCCGGC<br>AAGTGATGA |
| 442 | STIM005-<br>CDRL1 | Amino acid sequence<br>of CDRL1 of STIM005<br>using IMGT | QNINNF |
| 443 | STIM005-<br>CDRL2 | Amino acid sequence<br>of CDRL2 of STIM005<br>using IMGT | AAS |
| 444 | STIM005-<br>CDRL3 | Amino acid sequence<br>of CDRL3 of STIM005<br>using IMGT | QQSYGIPW |
| 445 | STIM005-<br>Light<br>chain<br>variable<br>region | Amino acid sequence<br>of V$_L$ of STIM005 | DIQMTQSPSSLSASVGDRVTITCRASQNINNFLNWYQQKEGKGPKLL<br>IYAASSLQRGIPSTFSGSGSGTDFTLTISSLQPEDFATYICQQSYGI<br>PWVGQGTKVEIK |
| 446 | STIM005-<br>Light<br>chain<br>variable<br>region | Nucleic acid<br>sequence of V$_L$ of<br>STIM005 | GACATCCAGATGACCCAGTCTCCATCCTCCCTGTCTGCATCTGTAGG<br>AGACAGAGTCACCATCACTTGCCGGGCAAGTCAGAACATTAATAACT<br>TTTTAAATTGGTATCAGCAGAAAGAAGGAAAGGCCCTAAGCTCCTG<br>ATCTATGCAGCATCCAGTTTGCAAAGAGGGATACCATCAACGTTCAG<br>TGGCAGTGGATCTGGGACAGACTTCACTCTCACCATCAGCAGTCTGC<br>AACCTGAAGATTTTGCAACTTACTATTGTCAACAGAGCTACGGTATC<br>CCGTGGGTCGGCCAAGGGACCAAGGTGGAAATCAAA |
| 447 | STIM005-<br>full<br>light<br>chain<br>sequence | Amino acid sequence<br>of STIM005 light<br>chain | DIQMTQSPSSLSASVGDRVTITCRASQNINNFLNWYQQKEGKGPKLL<br>IYAASSLQRGIPSTFSGSGSGTDFTLTISSLQPEDFATYICQQSYGI<br>PWVGQGTKVEIK<br>RTVAAPSVFIFPPSDEQLKSGTASVVCLLNNFYPREAKVQWKVDNAL<br>QSGNSQESVTEQDSKDSTYSLSSTLTLSKADYEKHKVYACEVTHQGL<br>SSPVTKSFNRGEC |

TABLE S2-continued

SEQ ID NOS: 343-538

| | | | |
|---|---|---|---|
| 448 | STIM005-full light chain sequence | Nucleic acid sequence of STIM005 light chain | GACATCCAGATGACCCAGTCTCCATCCTCCCTGTCTGCATCTGTAGG AGACAGAGTCACCATCACTTGCCGGCAAGTCAGAACATTAATAACT TTTTAAATTGGTATCAGCAGAAAGAAGGGAAAGGCCCTAAGCTCTG ATCTATGCAGCATCCAGTTTGCAAAGAGGGATCCATCAACGTTCAG TGGCAGTGGATCTGGGACAGACTTCACTCTCACCATCAGCAGTCTGC AACCTGAAGATTTTGCAACTTACATCTGTCAACAGAGCTACGTATC CCGTGGGTCGGCCAAGGGACCAAGGTGGAAATCAAAcgtacggtggc cgtccctcccgtgttcatcttccaccttccgacgagcagctgaagt ccggaaccgcttctgtgtgctgctgaacaacttctaccccgc gaggccaaggtgcagtggaaggtggacaacgccctgcagtccggcaa ctcccaggaatccgtgaccgacgaggactccaaggacagcacctact ccctgtcctccaccctgaccctgtccaaggccgactacgagaagcac aaggtgtacgcctgcgaagtgacccaccaggcctgtctagccccgt gaccaagtcttcaaccggggcagtgt |
| 449 | STIM006-CDRH1 | Amino acid sequence of CDRH1 of STIM006 using IMGT | GFTFSDYF |
| 450 | STIM006-CDRH2 | Amino acid sequence of CDRH2 of STIM006 using IMGT | ISSSGSTI |
| 451 | STIM006-CDRH3 | Amino acid sequence of CDRH3 of STIM006 using IMGT | ARDHYDGSGIYPLYYYYGLDV |
| 452 | STIM006-Heavy chain variable region | Amino acid sequence of V$_H$ of STIM006 | QVQLVESGGGLVKPGGSLRLSCAASGFTFSDYFMSWIRQAPGKGLEW ISYISSSGSTIYYADSVRGRFTISRDNAKYSLYLQMNSLRSEDTAVY YCARDHYDGSGIYPLYYYYGLDVWGQGTTVTVSS |
| 453 | STIM006-Heavy chain variable region | Nucleic acid sequence of V$_H$ of STIM006 | CAGGTGCAGCTGGTGGAGTCTGGGGGAGGCTTGGTCAAGCCTGGAGG GTCCCTGAGACTCTCCTGTGCAGCCTCTGGATTCACCTTCAGTGACT ACTTCATGAGCTGGATCCGCCAGGCGCCAGGGAAGGGGCTGGAGTGG ATTTCATACATTAGTTCTAGTGGTAGTACCATATACTACGCAGACTC TGTGAGGGCCGATTCACCATCTCCAGGGACAACGCCAAGTACTCAC TGTATCTGCAAATGAACAGCCTGAGATCCGAGGACACGGCCGTGTAT TACTGTGCCGAGAGATCACTACGATGGTTCGGGGATTTATCCCTCTA CTACTATTACGGTTTGGACGTCTGGGGCCAGGGGACCACGGTCACCG TCTCCTCA |
| 454 | STIM006-full heavy chain sequence | Amino acid sequence of STIM006 heavy chain | QVQLVESGGGLVKPGGSLRLSCAASGFTFSDYFMSWIRQAPGKGLEW ISYISSSGSTIYYADSVRGRFTISRDNAKYSLYLQMNSLRSEDTAVY YCARDHYDGSGIYPLYYYYGLDVWGQGTTVTVSSASTKGPSVFPLAP SSKSTSGTAALGCLVKDYFPEPVTVSWNSGALTSGVHTFPAVLQSS GLYSLSSVVTVPSSSLGTQTYICNVNHKPSNTKVDKKVEPKSCDKTH TCPPCPAPELLGGPSVFLFPPKDTLMISRTPEVTCVVVDVSHEDP |

TABLE S2-continued

SEQ ID NOS: 343-538

| | | |
|---|---|---|
| | | EVKFNWYVDGVEVHNAKTKPREEQYNSTYRVVSVLTVLHQDWLNGKE YKCKVSNKALPAPIEKTISKAKGQPREPQVYTLPPSRDELTKNQVSL TCLVKGFYPSDIAVEWESNGQPENNYKTTPPVLDSDGSFFLYSKLTV DKSRWQQGNVFSCSVMHEALHNHYTQKSLSLSPGK |
| 455 | STIM006-full heavy chain sequence | Nucleic acid sequence of STIM006 heavy chain | CAGGTGCAGCTGGTGGAGTCTGGGGGAGGCTTGGTCAAGCCTGGAGG GTCCCTGAGACTCTCCTGTGCAGCCTCTGGATTCACCTTCAGTGACT ACTTCATGAGCTGGATCCGCCAGGCGCCAGGGAAGGGGCTGGAGTGG ATTTCATACATTAGTTCTAGTGGTAGTACCATATACTACGCAGACTC TGTGAGGGGCCGATTCACCATCTCCAGGGACAACGCCAAGTACTCAC TGTATCTGCAAATGAACAGCCTGAGATCCGAGGACACGGCCGTGTAT TACTGTGCGAGAGATCACTACGATGGTTCGGGGATTTATCCCCTCTA CTACTATTACGGTTTGGACGTCTGGGGCCAAGGGACCACGGTCACCG TCTCCTCAGCCAGCACCAAGGGCCCCTCTGTTCCCCTCTGGCCCCCT TCCAGCAAGTCACCTCTGGCGAACAGCCGTCTCTGGGCTGCCTCGT GAAGGACTACTTCCCCGAGCCTGTGACCGTGTCCTGGAACTCTGGCG CTCTGACCAGCGGAGTGCACACCTTCCCTGCTGTGCTGCAGTCCTCC GGCCTGTACTCCCTGTCCTCCGTCGTGACCGTGCCTCCAGCTCTCT GGGCACCCAGACCTACATCTGCAACGTGAACCACAAGCCCTCCAACA CCAAGGTGGACAAGAAGGTGGAACCCAAGTCCTGCGACAAGACCCAC ACCTGTCCCCCTTGTCCTCCCGAACTGTGGGGCGGACCTTCCGT GTTCCTGTTCCCCCCAAAGCCCAAGGACACCCTGATGATCTCCCGGA CCCCGAAGTGACCTGCGTGGTGGTGGACGTGCCCGAATGTG CAACGC CAAGACCAAGCCTAGAGAGGAACAGTACAACTCCACCTACCGGGTGG TGTCCGTGCTGACCGTGCTGCACCAGGATTGGCTGAACGGCAAGAG TACAAGTGCAAGGTCTCCAACAAGGCCCTGCCTGCCCCCATCGAAAA GACCATCTCCAAGGCCAAGGGCCAGCCCCGGGAACCCCAGGTGTACA CACTGCCCCCTAGCAGGGACGAGCTGACCAAGAACCAGGTGTCCCTG ACCTGTCTGGTGAAAGGCTTCTACCCCTCCGATATCGCCGTGGAATG GGAGTCCAACGGCCAGCCTGAGAACAACTACAAGACCACCCCCCTG TGCTGGACTCCGACGGCTCATTCTTCCTGTACAGCAAGCTGACAGTG GACAAGTCCCGGTGGCAGCAGGGCAACGTGTTCTCCTGCTCCGTGAT GCACGAGCCCTGCACAACCACTACACCCAGAAGTCCCTGTCCCTGA GCCCCGGCAAGTGATGA |
| 456 | STIM006-CDRL1 | Amino acid sequence of CDRL1 of STIM006 using IMGT | QSLLHSNGYNY |
| 457 | STIM006-CDRL2 | Amino acid sequence of CDRL2 of STIM006 using IMGT | LGS |
| 458 | STIM006-CDRL3 | Amino acid sequence of CDRL3 of STIM006 using IMGT | MQALQTPRS |

TABLE S2-continued

| | | SEQ ID NOS: 343-538 | |
|---|---|---|---|
| 459 | STIM006-Light chain variable region | Amino acid sequence of V$_L$ of STIM006 | IVMTQSPLSLPVTPGEPASISCRSSQSLLHSNGYNYLDYYLQKPGQS PQLLIYLGSYRASGVPDRFSGSGSGTDFTLKISRVEAEDVGVYYCMQ ALQTPRSFGQGTTLEIK |
| 460 | STIM006-Light chain variable region | Nucleic acid sequence of V$_L$ of STIM006 | ATTGTGATGACTCAGTCTCCACTCTCCCTACCCGTCACCCCTGGAGA GCCGGCCTCCATCTCCTGCAGGTCTAGTCAGAGCCTCCTGCATAGTA ATGGATACAACTATTTGGATTATTACCTGCAGAAGCCAGGGCAGTCT CCACAGCTCCTGATCTATTTGGGTTCTTATCGGGCCTCCGGGGTCCC TGACAGGTTCAGTGGCAGTGGATCAGGCACAGATTTTACACTGAAAA TCAGCAGAGTGGAGGCTGAGGATGTTGGGGTTTATTACTGCATGCAA GCTCTACAAACTCCTCGCAGTTTTGGCCAGGGGACCACGCTGAGAT CAAA |
| 461 | STIM006-full light chain sequence | Amino acid sequence of STIM006 light chain | IVMTQSPLSLPVTPGEPASISCRSSQSLLHSNGYNYLDYYLQKPGQS PQLLIYLGSYRASGVPDRFSGSGSGTDFTLKISRVEAEDVGVYYCMQ ALQTPRSFGQGTTLEIKRTVAAPSVFIFPPSDEQLKSGTASVVCLLN NFYPREAKVQWKVDNALQSGNSQESVTEQDSKDSTYSLSSTLTLSKA DYEKHKVYACEVTHQGLSSPVTKSFNRGEC |
| 462 | STIM006-full light chain sequence | Nucleic acid sequence of STIM006 light chain | ATTGTGATGACTCAGTCTCCACTCTCCCTACCCGTCACCCCTGGAGA GCCGGCCTCCATCTCCTGCAGGTCTAGTCAGAGCCTCCTGCATAGTA ATGGATACAACTATTTGGATTATTACCTGCAGAAGCCAGGGCAGTCT CCACAGCTCCTGATCTATTTGGGTTCTTATCGGGCCTCCGGGGTCC TGACAGGTTCAGTGGCAGTGGATCAGGCACAGATTTTACACTGAAAA TCAGCAGAGTGGAGGCTGAGGATGTTGGGGTTTATTACTGCATGCAA GCTCTACAAACTCCTCGCAGTTTTGGCCAGGGGACCACGCTGAGAT CAAAcgtacggtggccgctcccgtgttcatcttcccaccttccg acgagcagttgaaagtctgcctgctgaacaacttctgtatccaggccg aacttctaccccgagaggccaactcccctgtcctccaccgagtggacaacgc cctgcagtccggcaactcccagggaatccgagtggaaggtggacaaccagga gagcagtgagaagcaagtgtacgcctgcgaagtgacccaccaggg cctgctagcccgtgaccaagtctttcaaccgggcgagtgt |
| 463 | STIM007-CDRH1 | Amino acid sequence of CDRH1 of STIM007 using IMGT | GFSLSTTGVG |
| 464 | STIM007-CDRH2 | Amino acid sequence of CDRH2 of STIM007 using IMGT | IYWDDDK |
| 465 | STIM007-CDRH3 | Amino acid sequence of CDRH3 of STIM007 using IMGT | THGYGSASYYHYGMDV |

TABLE S2-continued

| | | SEQ ID NOS: 343-538 | |
|---|---|---|---|
| 466 | STIM007-Heavy chain variable region | Amino acid sequence of V$_H$ of STIM007 | QITLKESGPTLVKPTQTLTLTCTFSGFSLSTTGVGVGMIRQPPGKAL EWLAVIYWDDDKRYSPSLKSRLTITKDTSKNQVVLTMTNMDPVDTAT YFCTHGYGSASYYHYGMDVWGQGTTVTVSS |
| 467 | STIM007-Heavy chain variable region | Nucleic acid sequence of V$_H$ of STIM007 | CAGATCACCTTGAAGGAGTCTGGTCCTACGCTGGTGAAACCCACACA GACCCTCACGCTGACCTGCACCTTCTCTGGGTTCTCACTCAGCACTA CTGGAGTGGGTGTGGGCTGGATCCGTCAGCCCCCAGGAAAGGCCTG GAGTGGCTTGCAGTCATTTATTGGGATGATGATAAGCGCTACAGCCC ATCTCTGAAGAGCAGACTCACCATCACCAAGGACACCTCCAAAAACC AGTGGTCCTTACAATGACCAACATGGACCCTGTGGACACAGCCACA TATTTCTGTACACACGGATATGGTTCGGCGAGTTATTACCACTACGG TATGGACGTCTGGGGCCAAGGGACCACCGTCACCGTCTCCTCA |
| 468 | STIM007-full heavy chain sequence | Amino acid sequence of STIM007 heavy chain | QITLKESGPTLVKPTQTLTLTCTFSGFSLSTTGVGVGMIRQPPGKAL EWLAVIYWDDDKRYSPSLKSRLTITKDTSKNQVVLTMTNMDPVDTAT YFCTHGYGSASYYHYGMDVWGQGTTVTVSSASTKGPSVFPLAPSSKS TSGGTAALGCLVKDYFPEPVTVSWNSGALTSGVHTFPAVLQSSGLYS LSSVVTVPSSSLGTQTYICNVNHKPSNTKVDKKVEPKSCDKTHTCPP CPAPELLGGPSVFLFPPKPKDTLMISRTPEVTCVVVDVSHEDPEVKF NWYVDGVEVHNAKTKPREEQYNSTYRVVSVLTVLHQDWLNGKEYKCK VSNKALPAPIEKTISKAKGQPREPQVYTLPPSRDELTKNQVSLTCLV KGFYPSDIAVEWESNGQPENNYKTTPPVLDSDGSFFLYSKLTVDKSR WQQGNVFSCSVMHEALHNHYTQKSLSLSPGK |
| 469 | STIM007-full heavy chain sequence | Nucleic acid sequence of STIM007 heavy chain | CAGATCACCTTGAAGGAGTCTGGTCCTACGCTGGTGAAACCCACACA GACCCTCACGCTGACCTGCACCTTCTCTGGGTTCTCACTCAGCACTA CTGGAGTGGGTGTGGGCTGGATCCGTCAGCCCCCAGGAAAGGCCTG GAGTGGCTTGCAGTCATTTATTGGGATGATGATAAGCGCTACAGCCC ATCTCTGAAGAGCAGACTCACCATCACCAAGGACACCTCCAAAAACC AGTGGTCCTTACAATGACCAACATGGACCCTGTGGACACAGCCACA TATTTCTGTACACACGGATATGGTTCGGCGAGTTATTACCACTACGG TATGGACGTCTGGGGCCAAGGGACCACCGTCACCGTCTCCTCA GCCAGCACCAAGGGCCCCTCTGTGTTCCCTCTGGCCCCTTCCAGCAA GTCCACCTCTGGCGGAACAGCCGCTCTGGGCTGCCTCGTGAAGGACT ACTTCCCCGAGCCTGTGACCGTGTCCTGGAACTCTGGCGCTCTGACC AGCGGAGTGCACACCTTCCCTGCTGTGCTGCAGTCCTCCGGCCTGTA CTCCCTGTCCTCCGTCGTGACCGTGCCCTTCCAGCTCTGGGCACCC AGACCTACATCTGCAACGTGAACCACAAGCCCTCCAACACCAAGGTG GACAAGAAGGTGGAGCCCAAGTCCTGCGACAAGACCCACACCTGTCC CCCTTGTCCCCCTGAACTGCTGGGCGGACCCTCCGTGTTCCTGT TCCCCCCAAAGCCCAAGGACACCCTGATGATCTCCCGGACCCCCGAA GTGACCTGCGTGGTGGTGGATGTGTCCCACGAAGGTGCACAACGCCAAGACCA AGCCTAGAGAGGAACAGTACAACTCCACCTACCGGGTGGTGTCCGTG CTGACCGTGCTGCACCAAGGCCTGAACTGGCTGAACGGCAAAGAGTACAAGTG CAAGGTCTCCAACAAGGCCCTGCCCGCCCCATCGAAACCCATCTCCC CAAGGCCAAGGGCCAGCCCCGGGAACCCAGGTGTACACCTGCCC CCTAGCAGGGACGAGCTGACCAAGAACCAGGTTCCTGACCGTCT CGTGAAAGGCTTCTACCCCTCGACATATGCCGTGAATGGGAGTCCA |

TABLE S2-continued

SEQ ID NOS: 343-538

| | | |
|---|---|---|
| | | ACGGCCAGCCTGAGAACAACTACAAGACCACCCCCCTGTGCTGGAC<br>TCCGACGGCTCATTCTTCCTGTACAGCAAGCTGACAAGTGACAAGTC<br>CCGGTGGCAGCAGGGCAACGTGTTCTCCTGCTCCGTGATGCACGAGG<br>CCCTGCACAACCACTACACCCAGAAGTCCCTGTCCCTGAGCCCCGGC<br>AAGTGATGA |
| 470 | STIM007-<br>CDRL1 | Amino acid sequence<br>of CDRL1 of STIM007<br>using IMGT | QSVTNY |
| 471 | STIM007-<br>CDRL2 | Amino acid sequence<br>of CDRL2 of STIM007<br>using IMGT | DAS |
| 472 | STIM007-<br>CDRL3 | Amino acid sequence<br>of CDRL3 of STIM007<br>using IMGT | QHRSNWPLT |
| 473 | STIM007-<br>Light<br>chain<br>variable<br>region | Amino acid sequence<br>of V_L of STIM007 | EIVLTQSPATLSLSPGERATLSCRASQSVTNYLAWHQQKPGQAPRLL<br>IYDASNRATGIPARFSGSGSGTDFTLTISSLEPEDFAVYYCQHRSNW<br>PLTFGGGTKVEIK |
| 474 | STIM007-<br>Light<br>chain<br>variable<br>region | Nucleic acid<br>sequence of V_L of<br>STIM007 | GAAATTGTATTGACACAGTCTCCAGCCACCCTGTCTTTGTCTCCAGG<br>GGAAAGAGCCACCCTCTCCTGCAGGGCCAGTCAGAGTGTTACCAACT<br>ACTTAGCCTGGCACCAACAGAAACCTGGCCAGGCTCCCAGGCTCCTC<br>ATCTATGATGCATCCAACAGGGCCACTGGCATCCCAGCCAGGTTCAG<br>TGGCAGTGGGTCTGGGACAGACTTCACTCTCACCATCAGCAGCCTAG<br>AGCCTGAAGATTTTGCAGTTTATTACTGCCAGCACCGTAGCAACTGG<br>CCTCTCACTTTCGGCGGAGGGACCAAGGTGGAGATCAAAC |
| 475 | STIM007-<br>full<br>light<br>chain<br>sequence | Amino acid sequence<br>of STIM007 light<br>chain | EIVLTQSPATLSLSPGERATLSCRASQSVTNYLAWHQQKPGQAPRLL<br>IYDASNRATGIPARFSGSGSGTDFTLTISSLEPEDFAVYYCQHRSNW<br>PLTFGGGTKVEIKRTVAAPSVFIFPPSDEQLKSGTASVVCLLNNFYP<br>REAKVQWKVDNALQSGNSQESVTEQDSKDSTYSLSSTLTLSKADYEK<br>HKVYACEVTHQGLSSPVTKSFNRGEC |
| 476 | STIM007-<br>full<br>light<br>chain<br>sequence | Nucleic acid<br>sequence of STIM007<br>light chain | GAAATTGTATTGACACAGTCTCCAGCCACCCTGTCTTTGTCTCCAGG<br>GGAAAGAGCCACCCTCTCCTGCAGGGCCAGTCAGAGTGTTACCAACT<br>ACTTAGCCTGGCACCAACAGAAACCTGGCCAGGCTCCCAGGCTCCTC<br>ATCTATGATGCATCCAACAGGGCCACTGGCATCCCAGCCAGGTTCAG<br>TGGCAGTGGGTCTGGGACAGACTTCACTCTCACCATCAGCAGCCTAG<br>AGCCTGAAGATTTTGCAGTTTATTACTGCCAGCACCGTAGCAACTGG<br>CCTCTCACTTTCGGCGGAGGGACCAAGGTGGAGATCAAACcgtacgg<br>tggccgctcctccgtcttcatcttccacctccgacgagcagctg<br>aagtccggacccgcttctgtgtgcctgctgaacaacttctacc<br>ccgcgaggccaaggtgcagtggaaggtggacaacgccctgcagtccg |

TABLE S2-continued

| SEQ ID NOS: 343-538 | | |
|---|---|---|
| 477 | STIM008-CDRH1 Amino acid sequence of CDRH1 of STIM008 using IMGT | gcaactcccaggaatcctgaccgagcgagcaggactccaaggacgagcacc tactccctgtcctccacctgacctgtccaaggccgactacgagaa gacaagtgtacgcctgcgaagtgacccaccagggcctgtctagcc ccgtgaccaagtctttcaaccgggcgagtgt<br><br>GFSLSTSGVG |
| 478 | STIM008-CDRH2 Amino acid sequence of CDRH2 of STIM008 using IMGT | IYWDDDK |
| 479 | STIM008-CDRH3 Amino acid sequence of CDRH3 of STIM008 using IMGT | THGYGSASYYHYGMDV |
| 480 | STIM008-Heavy chain variable region Amino acid sequence of V_H of STIM008 | QITLKESGPTLVKPTQTLTLTCTFSGFSLSTSGVGVGWIRQPPGKAL EWLAVIYWDDDKRYSPSLKSRLTITKDTSKNQVVLTMTNMDPVDTAT YFCTHGYGSASYYHYGMDVWGQGTTVTVSS |
| 481 | STIM008-Heavy chain variable region Nucleic acid sequence of V_H of STIM008 | CAGATCACCTTGAAGGAGTCTGGTCCTACGCTGGTGAAACCCACACA GACCCTCACGCTGACCTGCACCTTCTCTGGGTTCTCACTCAGCACTA GTGGAGTGGGTGTGGATCCGTCAGCCCCCAGGAAAGGCCCTG GAGTGGCTTGCAGTCATTTATTGGGATGATGATAAGCGCTACAGCCC ATCTCTGAAGAGCAGGCTCACCATCACCAAGGACACCTCCAAAAACC AGGTGGTCTTACAACGGATATGTTCGGCGAGTATTACCACTACGG TATGGACGTCTGGGGCCAAGGACCACCGTCACCGTCTCCTCA |
| 482 | STIM008-full heavy chain sequence Amino acid sequence of STIM008 heavy chain | QITLKESGPTLVKPTQTLTLTCTFSGFSLSTSGVGVGWIRQPPGKAL EWLAVIYWDDDKRYSPSLKSRLTITKDTSKNQVVLTMTNMDPVDTAT YFCTHGYGSASYYHYGMDVWGQGTTVTVSSASTKGPSVFPLAPSSKS TSGGTAALGCLVKDYFPEPVTVSWNSGALTSGVHTFPAVLQSSGLYS LSSVVTVPSSSLGTQTYICNVNHKPSNTKVDKKVEPKSCDKTHTCPP CPAPELLGGPSVFLFPPKPKDTLMISRTPEVTCVVVDVSHEDPEVKF NWYVDGVEVHNAKTKPREEQYNSTYRVVSVLTVLHQDWLNGKEYKCK VSNKALPAPIEKTISKAKGQPREPQVYTLPPSRDELTKNQVSLTCLV KGFYPSDIAVEWESNGQPENNYKTTPPVLDSDGSFFLYSKLTVDKSR WQQGNVFSCSVMHEALHNHYTQKSLSLSPGK |
| 483 | STIM008-full heavy chain sequence Nucleic acid sequence of STIM008 heavy chain | CAGATCACCTTGAAGGAGTCTGGTCCTACGCTGGTGAAACCCACACA GACCCTCACGCTGACCTGCACCTTCTCTGGGTTCTCACTCAGCACTA GTGGAGTGGGTGTGGATCCGTCAGCCCCCAGGAAAGGCCCTG GAGTGGCTTGCAGTCATTTATTGGGATGATGATAAGCGCTACAGCCC ATCTCTGAAGAGCAGGCTCACCATCACCAAGGACACCTCCAAAAACC AGGTGGTCTTACAACGGATATGTTCGGCGAGTATTACCACTACGG TATGGACGTCTGGGGCCAAGGACCACCGTCACCGTCTCCTCAGCCA |

TABLE S2-continued

SEQ ID NOS: 343-538

| | | |
|---|---|---|
| | | GCACCAAGGGCCCCTCTGTGTTCCCTCTGGCCCCTTCCAGCAAGTCC<br>ACCTCTGGCGGAACAGCCGCTCTGGGCTGCCTCGTGAAGGACTACTT<br>CCCCGAGCCTGTGACCGTGTCCTGGAACTCTGGCGCTCTGACCAGCG<br>GAGTGCACACCTTCCCTGCTGTCCTGCAGTCCTCCGGCCTGTACTCC<br>CTGTCCTCCGTCGTGACCGTGCCTTCCAGCTCTCTGGGCACCCAGAC<br>CTACATCTGCAACgTGAACCACAAGCCCTCCAACACCAAGGTGGACA<br>AGAAGGTGGAACCCAAGTCTTGCGACAAGACCCACACCTGTCCCCCT<br>TGTCCTGCCCCTGAACTGCTGGGCGGACCTTCCGTCTTCCTGTTCCC<br>CCCAAAGCCAAGGACACCCTGATGATCTCCCGGACCCCTGAAGTGA<br>CCTGCGTGGTGGTGGATGTGTCCCACGAGGACCCTGAAGTGAAGTTC<br>AATTGGTACGTGGACGGCGTGGAAGTGCACAACGCCAAGACCAAGCC<br>TAGAGAGGAACAGTACAACTCCACCTACCGGGTGGTGTCCGTGCTGA<br>CCGTGCTGCACCAGGATTGGCTGAACGGCAAAGAGTACAAGTGCAAG<br>GTGTCCAACAAGGCCCTGCCTGCCCCCATCGAAAAGACCATCTCCAA<br>GGCCAAGGGCCAGCCCGGGACCCAAGGTGTACACTGCCCCCTA<br>GCAGGGACGAGCTGACCAAGAACCAGGTGTCCCTGACCTGTCTGTG<br>AAAGGCTTCTACCCCTCCGATATCGCCGTGGAATGGAGTCCAACGG<br>CCAGCCTGAGAACAACTACAAGACCACCCCCTGTCTGGACAAGTCCG<br>ACGGCTCATTCTTCCTGTACAGCAAGCTGACAGTGGACAAGTCCCGG<br>TGGCAGCAGGGCAACGTGTTCTCCTGCTCCGTGATGCACGAGGCCCT<br>GCACAACCACTACACCCAGAAGTCCCTGTCCCTGAGCCCCGGCAAGT<br>GATGA |
| 484 | STIM008-CDRL1 | Amino acid sequence of CDRL1 of STIM008 using IMGT | QSVTNY |
| 485 | STIM008-CDRL2 | Amino acid sequence of CDRL2 of STIM008 using IMGT | DAS |
| 486 | STIM008-CDRL3 | Amino acid sequence of CDRL3 of STIM008 using IMGT | QQRSNWPLT |
| 487 | STIM008-Light chain variable region | Amino acid sequence of V$_L$ of STIM008 | EIVLTQSPATLSLSPGERATLSCRASQSVTNYLAWHQQKPGQAPRLL<br>IYDASNRATGIPARFSGSGSGTDFTLTISSLEPEDFAVYYCQQRSNW<br>PLTFGGGTKVEIK |
| 488 | STIM008-Light chain variable region | Nucleic acid sequence of V$_L$ of STIM008 | GAAATTGTGTTGACACAGTCTCCAGCCACCCTGTCTTTGTCTCCAGG<br>GGAAAGAGCCACCCTCTCCTGCAGGGCCAGTCAGAGTGTTACCAACT<br>ACTTAGCCTGGCACCAACAGAAACCTGGCCAGGCTCCCAGGCTCCTC<br>ATCTATGATGCATCCAACAGGGCCACTGGCATCCCAGCCAGGTTCAG<br>TGGCAGTGGGTCTGGGACAGACTTCACTCTCACCATCAGCAGCCTAG<br>AGCCTGAAGATTTTGCAGTTTATTACTGTCAGCAGCGTAGCAACTGG<br>CCTCTCACTTTCGGCGGAGGGACCAAGGTGGAGATCAAA |

TABLE S2-continued

SEQ ID NOS: 343-538

| | | | |
|---|---|---|---|
| 489 | STIM008-full light chain sequence | Amino acid sequence of STIM008 light chain | EIVLTQSPATLSLSPGERATLSCRASQSVTNYLAWHQQKPGQAPRLLIYDASNRATGIPARFSGSGSGTDFTLTISSLEPEDFAVYYCQQRSNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC |
| 490 | STIM008-full light chain sequence | Nucleic acid sequence of STIM008 light chain | GAAATTGTGTTGACACAGTCTCCAGCCACCCTGTCTTTGTCTCCAGGGGAAAGAGCCACCCTCTCCTGCAGGGCCAGTCAGAGTGTTACCAACTACTTAGCCTGGCACCAACAGAAACCTGGCCAGGCTCCCAGGCTCCTCATCTATGATGCATCCAACAGGGCCACTGGCATCCCAGCCAGGTTCAGTGGCAGTGGGTCTGGGACAGATTTCACTCTCACCATCAGCAGCCTAGAGCCTGAAGATTTTGCAGTTTATTACTGTCAGCAGCGTAGCAACTGGCCTCTCACTTTCGGCGGAGGGACCAAGGTGGAGATCAAAcgtacggtggccgctcccagcgtgttcatcttcccacctttccgaacaacttctacccagagggccacggtcctgtgtgctgctgaacaacttctacccccgagcgccaagtgcagtggaaggtggacaacgccctgcagtccggcaactcccaggaatccgtgaccgagcaggacagcaaggactccacctacagcctgagcagcacgctgaccctgagcaaggccgactacgagaagcacaaggtgtacgcctgcgaagtgacccaccagggcctgtctagccccgtgaccaagtctttcaaccggggcgagtgt |
| 491 | STIM009-CDRH1 | Amino acid sequence of CDRH1 of STIM009 using IMGT | GFTFSDYY |
| 492 | STIM009-CDRH2 | Amino acid sequence of CDRH2 of STIM009 using IMGT | ISSSGSTI |
| 493 | STIM009-CDRH3 | Amino acid sequence of CDRH3 of STIM009 using IMGT | ARDFYDILTDSPYFYYGVDV |
| 494 | STIM009-Heavy chain variable region | Amino acid sequence of V$_H$ of STIM009 | QVQLVESGGGLVKPGGSLRLSCAASGFTFSDYYMSWIRQAPGKGLEWVSYISSSGSTIYYADSVKGRFTISRDNAKNSLYLQINSLRAEDTAVYYCARDFYDILTDSPYFYYGVDVWGQGTTVTVSS |
| 495 | STIM009-Heavy chain variable region | Nucleic acid sequence of V$_H$ of STIM009 | CAGGTGCAGCTGGTGGAGTCTGGGGGAGGCTTGGTCAAGCCTGGAGGGTCCCTGAGACTCTCCTGTGCAGCCTCTGGATTCACCTTCAGTGACTACTACATGAGCTGGATCCGCCAGGCTCCAGGGAAGGGGCTGGAGTGGGTTTCATACATTAGTAGTAGTGGTAGTACCATATACTACGCAGACTCTGTGAAGGGCCGATTCACCATCTCCAGGGACAACGCCAAGAACTCACTGTATCTGCAAATTAACAGCCTGAGAGCCGAGGACACGGCCGTGTATTACTGTGCGAGAGATTTTTACGATATTTTGACTGATAGTCCGTACTTCTACTACGGTGTGGACGTCTGGGGCCAAGGGACCACGGTCACCGTCTCCTCA |

TABLE S2-continued

| | | SEQ ID NOS: 343-538 | |
|---|---|---|---|
| 496 | STIM009-full heavy chain sequence | Amino acid sequence of STIM009 heavy chain | QVQLVESGGGLVKPGGSLRLSCAASGFTFSDYYMSWIRQAPGKGLEWVSYISSSGSTIYYADSVKGRFTISRDNAKNSLYLQINSLRAEDTAVYYCARDFYDILTDSPYFYGVDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK |
| 497 | STIM009-full heavy chain sequence | Nucleic acid sequence of STIM009 heavy chain | CAGGTGCAGCTGGTGGAGTCTGGGGGAGGCTTGGTCAAGCCTGGAGGGTCCCTGAGACTCTCCTGTGCAGCCTCTGGATTCACCTTCAGTGACTACTACATGAGCTGGATCCGCCAGGCTCCAGGGAAGGGGCTGGAGTGGGTTTCATACATTAGTAGTAGTGGTAGTACCATATACTACGCAGACTCTGTGAAGGGCCGATTCACCATCTCCAGGGACAACGCCAAGAACTCACTGTATCTGCAAATTAACAGCCTGAGAGCCGAGGACACGGCCGTGTATTACTGTGCGAGAGATTTTTACGATATTTTGACTGATAGTCCGTATTCTTACACGGTGTGGACTCTGGGGCCAAGGGACCACGGTCACCGTCTCCTCAGCCAGCCAAGGGCCCATCGGTCTTCCCCCTGGCACCCTCCTCCAAGAGCACCTCTGGGGGCACAGCGGCCCTGGGCTGCCTGGTCAAGGACTACTTCCCCGAACCGGTGACGGTGTCGTGGAACTCTGGCGCTCTGACCAGCGGCGTGCACACCTTCCCGGCTGTCCTACAGTCCTCAGGACTCTACTCCCTCAGCAGCGTGGTGACCGTGCCCTCCAGCAGCTTGGGCACCCAGACCTACATCTGCAACGTGAATCACAAGCCCAGCAACACCAAGGTGGACAAGAAAGTTGAGCCCAAATCTTGTGACAAAACTCACACATGCCCACCGTGCCCAGCACCTGAACTCCTGGGGGGACCGTCAGTCTTCCTCTTCCCCCCAAAACCCAAGGACACCCTCATGATCTCCCGGACCCCTGAGGTCACATGCGTGGTGGTGGACGTGAGCCACGAAGACCCTGAGGTCAAGTTCAACTGGTACGTGGACGGCGTGGAGGTGCATAATGCCAAGACAAAGCCGCGGGAGGAGCAGTACAACAGCACGTACCGTGTGGTCAGCGTCCTCACCGTCCTGCACCAGGACTGGCTGAATGGCAAGGAGTACAAGTGCAAGGTCTCCAACAAAGCCCTCCCAGCCCCCATCGAGAAAACCATCTCCAAAGCCAAAGGGCAGCCCCGAGAACCACAGGTGTACACCCTGCCCCCATCCCGGGAGGAGATGACCAAGAACCAGGTCAGCCTGACCTGCCTGGTCAAAGGCTTCTATCCCAGCGATATCGCCGTGGAGTGGGAGAGCAATGGGCAGCCGGAGAACAACTACAAGACCACCCCTCCTGTGCTGGACTCCGACGGCTCCTTCTTCCTCTACAGCAAGCTGACCGTGGACAAGAGCAGGTGGCAGCAGGGGAACGTCTTCTCATGCTCCGTGATGCATGAGGCTCTGCACAACCACTACACGCAGAAGAGCCTCTCCCTGTCCCTGAGCCCTGGGTAAGTGATGA |
| 498 | STIM009-CDRL1 | Amino acid sequence of CDRL1 of STIM009 using IMGT | QSLLHSNGYNY |
| 499 | STIM009-CDRL2 | Amino acid sequence of CDRL2 of STIM009 using IMGT | LGS |

TABLE S2-continued

SEQ ID NOS: 343-538

| | | | |
|---|---|---|---|
| 500 | STIM009-CDRL3 | Amino acid sequence of CDRL3 of STIM009 using IMGT | MQALQTPRT |
| 501 | STIM009-Light chain variable region | Amino acid sequence of V_L of STIM009 | DIVMTQSPLSLPVTPGEPASISCRSSQSLLHSNGYNYLDWYLQKPGQ SPQLLIYLGSNRASGVPDRFSGSGSGTDFTLKISRVEAEDVGVYYCM QALQTPRTFGQGTKVEIK |
| 502 | STIM009-Light chain variable region | Nucleic acid sequence of V_L of STIM009 | GATATTGTGATGACTCAGTCTCCACTCTCCCTGCCCGTCACCCCTGG AGAGCCGGCCTCCATCTCCTGCAGGTCTAGTCAGAGCCTCCTGCATA GTAATGGATACAACTATTTGGATTGGTACCTGCAGAAGCCAGGCCAG TCTCCACAGCTCCTGATCTATTTGGGTTCTAATCGGGCCTCCGGGGT CCCTGACAGGTTCAGTGGCAGTGGATCAGGCACAGATTTTACACTGA AAATCAGCAGAGTGGAGGCTGAGGATGTTGGGGTTTATTACTGCATG CAAGCTCTACAAACTCCTCGGACGTTCGGCCAAGGGACCAAGGTGGA AATCAA |
| 503 | STIM009-Light full light chain sequence | Amino acid sequence of STIM009 light chain | DIVMTQSPLSLPVTPGEPASISCRSSQSLLHSNGYNYLDWYLQKPGQ SPQLLIYLGSNRASGVPDRFSGSGSGTDFTLKISRVEAEDVGVYYCM QALQTPRTFGQGTKVEIKRTVAAPSVFIFPPSDEQLKSGTASVVCLL NNFYPREAKVQWKVDNALQSGNSQESVTEQDSKDSTYSLSSTLTLSK ADYEKHKVYACEVTHQGLSSPVTKSFNRGEC |
| 504 | STIM009-full light chain sequence | Nucleic acid sequence of STIM009 light chain | GATATTGTGATGACTCAGTCTCCACTCTCCCTGCCCGTCACCCCTGG AGAGCCGGCCTCCATCTCCTGCAGGTCTAGTCAGAGCCTCCTGCATA GTAATGGATACAACTATTTGGATTGGTACCTGCAGAAGCCAGGCCAG TCTCCACAGCTCCTGATCTATTTGGGTTCTAATCGGGCCTCCGGGGT CCCTGACAGGTTCAGTGGCAGTGGATCAGGCACAGATTTTACACTGA AAATCAGCAGAGTGGAGGCTGAGGATGTTGGGGTTTATTACTGCATG CAAGCTCTACAAACTCCTCGGACGTTCGGCCAAGGGACCAAGGTGGA AATCAAAcgtacggtgccgctccctccgtgtcatcttccacctt ccgagcagcgaagctgaagccaccgctcttgtgtgcctgctg aacaactctacccccgaggcaaggtgcagtggaaggtggacaa cgccctgcagtccggcaactcccaggaatccgtgaccgaggact ccaaggacagcacctactcctgtccaccctgaccctgtccaag gccgactacgaagagcacaaggtgtacgcctgcgaagtgaccacca gggcctgtctagccgccgtgaccaagtcttcaaccgggcgagtgt |
| 505 | Human PD-L1 Flag His (KYPROT286) | Amino acid sequence of KYPROT286 with FLAG tag in bold and underlined and histidine tag in bold | FTVTVPKDLYVVEYGSNMTIECKFPVEKQLDLAALIVYWEMEDKNII QFVHGEEDLKVQHSSYRQRARLLKDQLSLGNAALQITDVKLQDAGVY RCMISYGGADYKRITVKVNAPYNKINQRILVVDPVTSEHELTCQAEG YPKAEVIWTSSDHQVLSGKTTTTNSKREEKLFNVTSTLRINTTTNEI FYCTFRRLDPEENHTAELVIPELPLAHPPNERTIEGRDYKDDDDKHH HHHH |
| 506 | Mature human ICOS | Mature amino acid sequence of human ICOS | EINGSANYEMFIFHNGGVQILCKYPDIVQQFKMQLLKGGQILCDLTK TKGSGNTVSIKSLKFCHSQLSNNSVSFFLYNLDHSHANYYFCNLSIF DPPPFKVTLTGGYLHIYESQLCCQLKFWLPIGCAAFVVVCILGCILI CWLTKKKYSSSVHDPNGEYMFMRAVNTAKKSRLTDVTL |

TABLE S2-continued

| | | SEQ ID NOS: 343-538 | |
|---|---|---|---|
| 507 | Human ICOS extracellular domain | Amino acid sequence of human ICOS extracellular domain | EINGSANYEMFIFHNGGVQILCKYPDIVQQFKMQLLKGGQILCDLTK TKGSGNTVSIKSLKFCHSQLSNNSVSFFLYNLDHSHANYYFCNLSIF DPPPFKVTLTGGYLHIYESQLCCQLKF |
| 508 | Human ICOS with signal peptide | Amino acid sequence of human ICOS (signal peptide is underlined) | MKSGLWYFFLFCLRIKVLTGEINGSANYEMFIFHNGGVQILCKYPDI VQQFKMQLLKGGQILCDLTKTKGSGNTVSIKSLKFCHSQLSNNSVSF FLYNLDHSHANYYFCNLSIFDPPPFKVTLTGGYLHIYESQLCCQLKF WLPIGCAAFVVVCILGCILICWLTKKKYSSSVHDPNGEYMFMRAVNT AKKSRLTDVTL |
| 509 | Isoform of human ICOS (Q9Y6W8-2) | Amino acid sequence of a human ICOS isoform | The sequence of this isoform differs from the canonical sequence in its cytoplasmic domain as follows: 168-199: KYSSSVHDPNGEYMFMRAVNTAKKSRLTDVTLM |
| 510 | Mature mouse ICOS | Mature amino acid sequence of mouse ICOS | EINGSADHRMFSFHNGGVQISCKYPETVQQLKMRLFREREVLCELTK TKGSGNAVSIKNPMLCLYHLSNNSVSFFLNNPDSSQGSYYFCSLSIF DPPPFQERNLSGGYLHIYESQLCCQLKIVVQVTE |
| 511 | Mouse ICOS extracellular domain | Amino acid sequence of the extracellular domain of mouse ICOS | EINGSADHRMFSFHNGGVQISCKYPETVQQLKMRLFREREVLCELTK TKGSGNAVSIKNPMLCLYHLSNNSVSFFLNNPDSSQGSYYFCSLSIF DPPPFQERNLSGGYLHIYESQLCCQLK |
| 512 | Mouse ICOS with signal peptide | Amino acid sequence of mouse ICOS (signal peptide is underlined) | MGWSCIILFLVATATGVHSEINGSADHRMFSFHNGGVQISCKYPETV QQLKMRLFREREVLCELTKTKGSGNAVSIKNPMLCLYHLSNNSVSFF LNNPDSSQGSYYFCSLSIFDPPPFQERNLSGGYLHIYESQLCCQLKI VVQVTE |
| 513 | Cynomolgus ICOS with signal peptide | Amino acid sequence of cynomolgus ICOS (signal peptide is underlined) | MKSGLWYFFL FCLHMKVLTG EINGSANYEM FIFHNGGVQI LCKYPDIVQQ FKMQLLKGGQILCDLTKTKGSGNKVSIKSLKFCHSQLSNNSVSFFLY NLD RSHANYYFCNLSIFDPPPFKVTLTGGYLHIYESQLCCQLKFWLPIGC ATF VVVCIFGCILICWLTKKYSSTVHDPNGEYMFMRAVNTAKKSRLTGT TP |
| 514 | Cynomolgus ICOS extracellular domain | Amino acid sequence of cynomolgus ICOS extracellular domain | EINGSANYEMFIFHNGGVQILCKYPDIVQQFKMQLLKGGQILCDLTK TKG SGNKVSIKSLKFCHSQLSNNSVSFFLYNLDRSHANYYFCNLSIFDPP PFK VTLTGGYLHIYESQLCCQLK |
| 515 | Human ICOS ligand | Amino acid sequence of human ICOS ligand comprising extracellular domain | DTQEKEVRAMVGSDVELSCACPEGSRFDLNDVVYWQTSESKTVVTY HIPQNSSLENVDSRYRNRALMSPAGMLRGDFSLRLFNVTPQDEQKFH CLVLSQSLGFQEVLSVEVTLHVAANFSVPVVSAPHSPSQDELTFTCT SINGYPRPNVYWINKTDNSLLDQALQNDTVFLNMRGLYDVVSVLRIA RTPSVNIGCCIENVLLQQNLTVGSQTGNDIGERDKITENPVSTGEKN AATWS |

TABLE S2-continued

| SEQ ID NOS: 343-538 | | |
|---|---|---|
| 516 | Human ICOS ligand | MRLGSPGLLFLLFSSLRADTQEKEVRAHVGSDVELSCACPEGSRFDL NDVYVYWQTSESKTVVTYHIPQNSSLENVDSRYRNRALMSPAGMLRG DFSLRLFNVTPQDEQKFHCLVLSQSLGFQEVLSVEVTLHVAANFSVP VVSAPHSPSQDELITFCTSINGYPRPNVYWINKTDNSLLDQALQNDT VFLNMRGLYDVVSVLRIARTPSVNIGCCIENVLLQQNLTVGSQTGND IGERDKITENPVSTGEKNAATWSILAVLCLLVVVAVAIGWCRDRCL QHSYAGAWAVSPETELTGHV |

SEQ ID NO: 610 ICOSL-Fc
DTQEKEVRAMVGSDVELSCACPEGSRFDLNDVYVYWQTSESKTVVTYHIPQNSSLENVDSRYRNRALMSPAGMLRGDFSLRLFNVT
PQDEQKFHCLVLSQSLGFQEVLSVEVTLHVAANFSVPVVSAPHSPSQDELITFCTSINGYPRPNVYWINKTDNSLLDQALQNDTVF
LNMRGLYDVVSVLRIARTPSVNIGCCIENVLLQQNLTVGSQTGNDIGERDKITENPVSTGEKNAATWSDIEGRMDPKSCDKTHTCP
PCPAPELLGGPSVFLFPPKPKDTLMISRTPEVTCVVVDVSHEDPEVKFNWYVDGVEHNAKTKPREEQYNSTYRVVSVLTVLHQDW
LNGKEYKCKVSNKALPAPIEKTISKAKGQPREPQVYTLPPSRDELTKNQVSLTCLVKGFYPSDIAVEWESNGQPENNYKTTPPVLD
SDGSFFLYSKLTVDKSRWQQGNVFSCSVMHEALHNHYTQKSLSLSPGK
Linker is underlined and in bold. Sequence preceding linker is human ICOSL (B7-H2).
Sequence following linker is human IgG1 Fc.

| 517 | C-terminal amino acid sequence of hIL-2 | Amino acids 21 to 133 of hIL-2 with R38W mutation (bold & underlined) | LQMILNGINNYKNPKLTAMLTFKFYMPKKATELKHLQCLE EELKPLEEVLNLAQSKNFHLRPRDLISNINVIVLELKGSE TTFMCEYADETATIVEFLNRWITFCQSIISTLT |
| 518 | C-terminal amino acid sequence of hIL-2 | Amino acids 21 to 133 of hIL-2 with R38Q mutation (bold & underlined) | LQMILNGINNYKNPKLTQMLTFKFYMPKKATELKHLQCLE EELKPLEEVLNLAQSKNFHLRPRDLISNINVIVLELKGSE TTFMCEYADETATIVEFLNRWITFCQSIISTLT |
| 519 | STIM002-Corrected Light chain variable region | Nucleic acid sequence of corrected V_L of STIM002 | GATATTGTGATGACTCAGTCTCCACTCTCCCTGCCCGTCA CCCCTGGAGAGCCGGCCTCCATCTCCTGCAGGTCTAGTCA GAGCCTCCTGCATAGTGATGATACAACTATTTGGATTGG TACCTGCAGAAGCCAGGGCAGTCTCCACAGCTCCTGATCT ATTTGGGTTCTACTGGGCCTCCGGGTTCCCTGACAGTT CAGTGGCAGTGGATCAGGCACAGATTTTACACTGAAAATC AGCAGAGTGGAGGCTGAGGATGTTGGGTTTATTACTGCA TGCAAGCTCTACAAACTCCGCTCAGTTTTGGCCAGGGGAC CAAGCTGGAGATCAAA |
| 520 | STIM002-Corrected full light chain sequence | Nucleic acid sequence of corrected STIM002 light chain | GATATTGTGATGACTCAGTCTCCACTCTCCCTGCCCGTCA CCCCTGGAGAGCCGGCCTCCATCTCCTGCAGGTCTAGTCA GAGCCTCCTGCATAGTGATGATACAACTATTTGGATTGG TACCTGCAGAAGCCAGGGCAGTCTCCACAGCTCCTGATCT ATTTGGGTTCTACTGGGCCTCCGGGTTCCCTGACAGTT CAGTGGCAGTGGATCAGGCACAGATTTTACACTGAAAATC AGCAGAGTGGAGGCTGAGGATGTTGGGTTTATTACTGCA TGCAAGCTCTACAAACTCCGCTCAGTTTTGGCCAGGGGAC CAAGCTGGAGATCAAAcgtacggtggccgctcccctccgtg ttcatcttcccacctccgacgagcagttgaaagtccggca |

TABLE S2-continued

SEQ ID NOS: 343-538

| | | |
|---|---|---|
| | | ccgcttctgtgtgctgctgaacaacttctaccccg cgaggccaaggtgcagtggaaggtggacaacgcctgcag tcggcaactccaggaatccgtgaccgagcaggactcca aggacagcacctactccctgtcctccaccctgaccctgtc caaggcgactacgagagcacaaggtgacgctgcgaa gtgaccaccaggcctgctagcccgtgaccaagtctt tcaaccggggcgagtgt |
| 521 | STIM003-<br>Corrected heavy<br>chain variable<br>region | Nucleic acid<br>sequence of<br>corrected $V_H$ of<br>STIM003 | GAGGTGCAGCTGGTGGAGTCTGGGGGAGGTGTGGTACGGC<br>CTGGGGGTCCCTGAGACTCTCCTGTGTAGCCTCTGGAGT<br>CACCTTTGATGATTATGCATGAGCTGGGTCCGCCAAGCT<br>CCAGGGAAGGGCTGGAGTGGGTCTCTGGTATTAATTGAA<br>ATGTGGCGACACAGATTATTCAGACTCTGTGAAGGGCCG<br>ATTCACCATCTCCAGAGACAACGCCAAGAACTCCCTGTAT<br>CTACAAATGAATAGTCTGAGAGCCGAGGACACGGCCTTGT<br>ATTACTGTGCGAGGGATTTCTATGGTTCGGGGAGTTATTA<br>TCACGTTCCTTTTGACTACTGGGGCCAGGGAATCCTGGTC<br>ACCGTCTCCTCA |
| 522 | STIM003-<br>Corrected full<br>heavy chain<br>sequence | Nucleic acid<br>sequence of<br>corrected STIM003<br>heavy chain | GAGGTGCAGCTGGTGGAGTCTGGGGGAGGTGTGGTACGGC<br>CTGGGGGTCCCTGAGACTCTCCTGTGTAGCCTCTGGAGT<br>CACCTTTGATGATTATGCATGAGCTGGGTCCGCCAAGCT<br>CCAGGGAAGGGCTGGAGTGGGTCTCTGGTATTAATTGGA<br>ATGGTGGCGACACAGATTATTCAGACTCTGTGAAGGGCCG<br>ATTCACCATCTCCAGAGACAACGCCAAGAACTCCCTGTAT<br>CTACAAATGAATAGTCTGAGAGCCGAGGACACGGCCTTGT<br>ATTACTGTGCGAGGGATTTCTATGGTTCGGGGAGTTATTA<br>TCACGTTCCTTTTGACTACTGGGGCCAGGGAATCCTGTC<br>ACCGTCTCCTCAGCACCAAGGGCCCCTCTGTGTTCC<br>CTCTGGCCCCTTCCTGTGACCTGTGTAGCCTCTGAGT<br>CGCTCTGGGCTGCCTCGTGAAGGACTACTTCCCCGAGCCT<br>GTGACCGTGTCCTGGAACTCTGCGCTCTGACCAGCGGAG<br>TGCACACCTTCCCGGCTGTGCTGCAGTCCTCCGGCTCTA<br>CTCCCTCAGCAGCGTGACCGTGCCCTCCAGCTCTCTG<br>GGCACCCAGACCTACATCTGCAACGTGAATCCAAGTCTG<br>CCAACACAAGGTGGACAAGAGGTGAACCAAGTCTCTG<br>CGACAAGACCACCTGTCCCCTTGTCCTGCCCCTGAA<br>CTGCTGGGCGACCTTCCGTGTCCTGTTCCCCCAAAGC<br>CCAAGGACACCCTGATGATCTCCCGGACCCCTGAAGTGAC<br>CTGCGTGGTGGTGGATGTGTCCCACGAGGACCCTGAAGTG<br>AAGTTCAATTGGTACGTGGACGGCGTGGAAGTGCACACG<br>CCAAGACCAAGCCTAGAGAGGAACAGTACAACTCCACCTA<br>CCGGGTGGTGTCCGTGCTGACCGTGCTGCACCAGGATTGG<br>CTGAACGGCAAAGAGTACAAGTGCAAGGTGTCCAACAAGG<br>CCCTGCCTGCCCCATCGAAAAAGACCATCTCCAAGGCCAA<br>GGGCCAGCCCCGGGAACCCCAGGTGTACACACTGCCCCCT<br>AGCAGGGACGAGCTTGACCAAGAACCAGTGTCCTGACCT<br>GTCTCGTGAAAGGCTTCTACCCCTCCGATATCGCCGTGGA<br>ATGGGAGTCCAACGGCCAGCCTGAGAACTACAAGACC<br>ACCCCCCTGTCTGACTCCGACGGCTCATTCTTCTGT<br>ACAGCAAGCTGACAGTGACAAGTCCCGGTGACGAGCAGGG |

TABLE S2-continued

SEQ ID NOS: 343-538

| | | | |
|---|---|---|---|
| 523 | Human IgG1 constant region | IGHG1*03 | Human Heavy Chain Constant Region (IGHG1*03) Nucleotide Sequence | CAACGTGTTCTCCTGCTCCGTGATGCACGAGGCCCTGCAC<br>AACCACTACACCCAGAAGTCCCTGTCCCTGAGCCCCGGCA<br>AGTGATGA<br>gcctccaccaagggcccatcggtcttccccctggcaccct<br>cctccaagagcacctctgggggcacagcggccctgggctg<br>cctggtcaaggactacttccccgaaccggtgacggtgtcg<br>tggaactcaggcgccctgaccagcggcgtgcacacctcc<br>cggctgtcctacagtcctcaggactctactccctcagcag<br>cgtggtgaccgtgccctccagcagcttgggcacccagacc<br>tacatctgcaacgtgaatcacaagcccagcaacaccaagg<br>tggacaagagagttgagcccaaatcttgtgacaaaactca<br>cacatgcccaccgtgcccagcacctgaactcctgggggga<br>ccgtcagtcttcctcttccccccaaaacccaaggacaccc<br>tcatgatctcccggacccctgaggtcacatgcgtggtggt<br>ggacgtgagccacgaagaccctgaggtcaagttcaactgg<br>tacgtggacggcgtggaggtgcataatgccaagacaaagc<br>cgcgggaggagcagtacaacagcacgtaccgtgtggtcag<br>cgtcctcaccgtcctgcaccaggactggctgaatggcaag<br>gagtacaagtgcaaggtctccaacaaagcctcccagccc<br>ccatcgagaaaaccatctccaaagccaaagggcagccccg<br>agaaccacaggtgtacaccctgccccccatccgggaggag<br>atgaccaagaaccaggtcagcctgacctgcctggtcaaag<br>gcttctatcccagcgacatcgccgtggagtgggagagcaa<br>tgggcagccggagaacaactacaagaccacgcctcccgtg<br>ctggactccgacggctccttcttcctctatagcaagctca<br>ccgtggacaagagcaggtggcagcaggggaacgtcttctc<br>atgctccgtgatgcatgaggctctgcacaaccactacacg<br>cagaagagctctccctgtccccgggtaaa |
| 524 | | | Human Heavy Chain Constant Region (IGHG1*03) Protein Sequence | ASTKGPSVFPLAPSSKSTSG<br>GTAALGCLVKDYFPEPVTVS<br>WNSGALTSGVHTFPAVLQSS<br>GLYSLSSVVTVPSSSLGTQT<br>YICNVNHKPSNTKVDKRVEP<br>KSCDKTHTCPPCPAPELLGG<br>PSVFLFPPKPKDTLMISRTP<br>EVTCVVVDVSHEDPEVKFNW<br>YVDGVEVHNAKTKPREEQYN<br>STYRVVSVLTVLHQDWLNGK<br>EYKCKVSNKALPAPIEKTIS<br>KAKGQPREPQVYTLPPSREE<br>MTKNQVSLTCLVKGFYPSDI<br>AVEWESNGQPENNYKTTPPV<br>LDSDGSFFLYSKLTVDKSRW<br>QQGNVFSCSVMHEALHNHYT<br>QKSLSLSPGK |
| 525 | Human IgG1 constant region | IGHG1*04 | Human Heavy Chain Constant Region (IGHG1*04) Nucleotide | gcctccaccaagggcccatcggtcttccccctggcaccct<br>cctccaagagcacctctgggggcacagcggccctgggctg<br>cctggtcaaggactacttccccgaaccggtgacggtgtcg<br>tggaactcaggcgccctgaccagcggcgtgcacaccttcc |

| SEQ ID NOS: 343-538 | | Sequence |
|---|---|---|
| 526 | Human Heavy Chain Constant Region (IGHG1*04) Protein Sequence | cggctgtcctacagtcctcaggactcttactcctcagcag<br>cgtgtgaccgtgcctccagcagcttggcagacaccaagg<br>tacatctgcaacgtgaatcacaagcccagcaacaccaagg<br>tggacaagaaagttgagccagcctgacaaactca<br>cacatccaccgtgccagcctgaactcctggggga<br>ccgtcagtcttctcttcccccaaaaccaagcaccc<br>tcatgatctcccggaccctgaggtcacatgcgtggt<br>ggacgtgagccacgaagacccctgaggtcaagttcaactgg<br>tacgtggacggcgtggaggtgcataatgccaagacaaag<br>ccgcgggaggagcagtacaacagcacgtaccgtgtggtcag<br>cgtcctcaccgtcctgcaccaggactggctgaatggcaag<br>gagtacaagtgcaaggtctccaacaaagccctcccagcc<br>ccatcgagaaaaccatctccaaagccaaagggcagccccg<br>agaaccacaggtgtacaccctgccccatccgggatgag<br>ctgaccaagaaccaggtcagcctgacctgcctggtcaaag<br>gcttctatcccagcgacatcgccgtggagtgggagcaa<br>tgggcagccggagaacaactacaagaccacgcctcccgtg<br>ctggactccgacggctccttctcctacagcaagctca<br>ccgtggacaagagcaggtggcagcaggggaacattctc<br>atgctccgtgatgcatgaggctctgcacaaccactacg<br>cagaagagcctctccctgtctccgggtaaa<br>ASTKGPSVFPLAPSSKSTSGGTAALGCLVKDYFPEPVTVS<br>WNSGALTSGVHTFPAVLQSSGLYSLSSVVTVPSSSLGTQT<br>YICNVNHKPSNTKVDKKVEPKSCDKTHTCPPCPAPELLGG<br>PSVFLFPPKPKDTLMISRTPEVTCVVVDVSHEDPEVKFNW<br>YVDGVEVHNAKTKPREEQYNSTYRVVSVLTVLHQDWLNGK<br>EYKCKVSNKALPAPIEKTISKAKGQPREPQVYTLPPSRDE<br>LTKNQVSLTCLVKGFYPSDIAVEWESNGQPENNYKTTPPV<br>LDSDGSFFLYSKLTVDKSRWQQGNIFSCSVMHEALHNHYT<br>QKSLSLSPGK |
| 527 | Human Heavy Chain Constant Region (IGHG2*01) Nucleotide Sequence<br>IGHG2*01 & IGHG2*03 & IGHG2*05 | gcctccaccaaggccccatcggtcttccccctggcgccct<br>gctccaggagcacctccgagagcacagcccctggctg<br>cctggtcaaggactacttccccgaaccggtgacggtgtcg<br>tggaactcaggcgctctgaccagcggcgtgcacacctcc<br>cagctcagcgtcctcaccaagactctactccctcagcag<br>cgtggtgaccgtgccctccagcaacttcggcaccagacc<br>tacacctgcaacgtagatcacaagcccagcaacaccaagg<br>tggacaagacagttgagcgcaaatgttgtgtcgagtgccc<br>accgtgcccagcaccacctgtggcaggaccgtcagtcttc<br>ctcttccccccaaaacccaaggacaccctcatgatcccc<br>cgaagacccctgaggtcacgtgcgtggtggtggacgtgagccac<br>gaagaccccgaggtccagttcaactggtacgtggacggc<br>gtggaggtgcataatgccaagacaaagccacgggaggagc<br>agttcaacagcacgttccgtgtggtcagcgtcctcaccgt<br>tgtgcaccaggactggctgaacggcaaggagtacaagtgc<br>aaggtctccaacaaaggcctcccagcccccatcgagaaaa<br>ccatctccaaaaccaaaggggcagccccgagaaccacaggt<br>gtacaccctgcccccatcccgggaggagatgaccaagaac<br>caggtcagcctgacctgcctggtcaaaggcttctaccccca<br>gcgacatcgccgtggagtgggagagcaatgggcagccgga<br>gaacaactacaagaccacacctcccatgctggactccgac |

TABLE S2-continued

SEQ ID NOS: 343-538

| | | | |
|---|---|---|---|
| 528 | | Human Heavy Chain Constant Region (IGHG2*01) Protein Sequence | ggctccttcttcctctacagcaagctcaccgtggacaaga gcaggtggcagcagggaacgtctttctcatgctccgtgat gcatgaggctgcacaaccactacgcagaagagcctc tccctgtctccgggtaaa<br>ASTKGPSVFPLAPCSRSTSESTAALGCLVKDYFPEPVTVS WNSGALTSGVHTFPAVLQSSGLYSLSSVVTVPSSNFGTQT YTCNVDHKPSNTKVDKTVERKCCVECPPCPAPPVAGPSVF LFPPKPKDTLMISRTPEVTCVVVDVSHEDPEVQFNWYVDG VEVHNAKTKPREEQFNSTFRVVSVLTVVHQDWLNGKEYKC KVSNKGLPAPIEKTISKTKGQPREPQVYTLPPSREEMTKN QVSLTCLVKGFYPSDIAVEWESNGQPENNYKTTPPMLDSD GSFFLYSKLTVDKSRWQQGNVFSCSVMHEALHNHYTQKSL SLSPGK |
| 529 | IGHG 2*02 | Human Heavy Chain Constant Region (IGHG2*02) Nucleotide Sequence | GCCTCCACCAAGGGCCCATGGTCTTCCCCCTGGCGCCT GCTCCAGGAGCACCTCCGAGAGCACAGCGGCCCTGGGCTG CCTGGTCAAGGACTACTTCCCCGAACCGGTGACGGTGTCG TGGAACTCAGGCGCTCTGACCAGCGGCGTGCACACCTTCC CGGCTGTCCTACAGTCCTCACGACTCTACTCCCTCAGCAG CGTGGTGACCGTGACCTCCAGCAACTTCGGCACCCAGACC TACACCTGCAACGTAGATCACAAGCCCAGCAACACCAAGG TGGACAAGACAGTTGAGCGCAAATGTTGTGTCGAGTGCCC ACCGTCCCCAGCACCTGTGCAGGACCCTCAGTCTTC CTCTTCCCCCCAAAACCCAAGGACACCCTCATGATCTCC GGACCCCTGAGGTCACGTGCCTGGTGGTGGACGTGAGCCA CGAAGACCCCGAGGTCCAGTTCAACTGGTACGTGGACGGC ATGGAGGTGCATAATGCCAAGACAAAGCCACGGGAGGAGC AGTTCAACAGCACGTTCCGTGTGGTCAGCGTCCTCACCGT CGTGCACCAGGACTGGCTGAACGGCAAGGAGTACAAGTGC AAGGTCTCCAACAAAGGCCTCCCAGCCCCCATCGAGAAAA CCATCTCCAAAACCAAAGGCCAGCCCCGAGAACCACAGGT GTACACCCTGCCCCCATCCCGGGAGGAGATGACCAAGAAC CAGGTCAGCCTGCCGTGCCTGGTCAAAGGCTTCTACCCCA GCGACATCGCCGTGGAGTGGGAGAGCAATGGGCAGCCGGA GAACAACTACAAGACCACACCTCCCATGCTGGACTCCGAC GGCTCCTTCTTCCTCTACAGCAAGCTCACCGTGGACAAGA GCAGGTGGCAGCAGGGGAACGTCTTCTCATGCTCCGTGAT GCATGAGGCTCTGCACAACCACTACACACAGAAGAGCCTC TCCCTGTCTCCGGGTAAA |
| 530 | | Human Heavy Chain Constant Region (IGHG2*02) Protein Sequence | ASTKGPSVFPLAPCSRSTSESTAALGCLVKDYFPEPVTVS WNSGALTSGVHTFPAVLQSSGLYSLSSVVTVPSSNFGTQT YTCNVDHKPSNTKVDKTVERKCCVECPPCPAPPVAGPSVF LFPPKPKDTLMISRTPEVTCVVVDVSHEDPEVQFNWYVDG MEVHNAKTKPREEQFNSTFRVVSVLTVVHQDWLNGKEYKC KVSNKGLPAPIEKTISKTKGQPREPQVYTLPPSREEMTKN QVSLTCLVKGFYPSDIAVEWESNGQPENNYKTTPPMLDSD GSFFLYSKLTVDKSRWQQGNVFSCSVMHEALHNHYTQKSL SLSPGK |

| | | TABLE S2-continued | |
|---|---|---|---|
| | | SEQ ID NOS: 343-538 | |
| 531 | Human IgG2 constant region | IGHG 2*04 | Human Heavy Chain Constant Region (IGHG2*04) Nucleotide Sequence | gcctccaccaaggcccatcggtcttcccctggcgcct gctccaggagcacctccgagagcacagcggccctggctg cctggtcaaggactacttcccgaaccggtgacggtgtcg tggaactcaggcgctctgaccagcggcgtgcacaccttcc cagctgtcctacagtcctcaggactctactcctcagcag cgtggtgaccgtgcctccagcagcttggcacccagacc tacacctgcaacgtagatcacaagcccagcaacaccaagg tggacaagacagttgagcgcaaatgttgtgtcgagtgccc acgtgcccaccctgtggcaggacgtcagtcttc ctcttccccccaaaaaccaaggacaccctcatgatctcc ggaccctgaggtcacgtgcgtggtggtggacgtgagcca cgaagacccgaggtccagttcaactggtacgtggacggc gtggaggtgcataatgccaagacaaagccacggaggagc agttcaacagcacgttccgtgtggtcagcgtcctcaccgt tgtgaccaggactgctgaaccgcaaggagtacaagtgc aaggtctccaacaaaggcctcccagcccccatcgagaaaa ccatctccaaaagggcagccccgagaaccacaggt gtacaccctgcccccatccgggaggagatgaccaagaac caggtcagctgacctgcctggtcaaaggcttctacccca gcgacatcgccgtggagtgggagagcaatgggcagccgga gaacaactacaagaccacacctcccgtgctggactccgac ggctccttcttcctctacagcaagctcaccgtggacaaga gcaggtggcagcaggggaacgtcttctcatgctccgtgat gcatgaggctctgcacaaccactacacgcagaagagcctc tccctgtctccgggtaaa |
| 532 | | | Human Heavy Chain Constant Region (IGHG2*04) Protein Sequence | ASTKGPSVFPLAPCSRSTSESTAALGCLVKDYFPEPVTVS WNSGALTSGVHTFPAVLQSSGLYSLSSVVTVPSSSLGTQT YTCNVDHKPSNTKVDKTVERKCCVECPPCPAPPVAGPSVF LFPPKPKDTLMISRTPEVTCVVVDVSHEDPEVQFNWYVDG VEVHNAKTKPREEQFNSTFRVVSVLTVVHQDWLNGKEYKC KVSNKGLPAPIEKTISKTKGQPREPQVYTLPPSREEMTKN QVSLTCLVKGFYPSDIAVEWESNGQPENNYKTTPPMLDSD GSFFLYSKLTVDKSRWQQGNVFSCSVMHEALHNHYTQKSL SLSPGK |
| 533 | Human IgG2 constant region | IGHG 2*06 | Human Heavy Chain Constant Region (IGHG2*06) Nucleotide Sequence | GCCTCCACCAAGGGCCCATCGGTCTTCCCCCTGGCGCCT GCTCCAGGAGCACTTCCGAGAGCACAGCGGCCCTGGGCTG CCTGGTCAAGGACTACTTCCCCGAACCGGTGACGGTGTCG TGGAACTCAGGCGCTCTGACCAGCGGCGTGCACACCTTCC CGGCTGTCCTACAGTCCTCACGACTCTACTCCTCAGCAG CGTGGTGACCGTGCCCTCCAGCAGCTTGGCACCCAGACC TACACCTGCAACGTAGATCACAAGCCCAGCAACACCAAGG TGGACAAGACAGTTGAGCGCAAATGTTGTGTCGAGTGCCC ACCGTGCCCAGCACCACCTGTGGCAGGACCGTCAGTCTTC CTCTTCCCCCCAAAACCCAAGGACACCCTCATGATCTCC GGACCCCTGAGGTCACGTGCGTGGTGGTGGACGTGAGCCA CGAAGACCCCGAGGTCCAGTTCAACTGGTACGTGGACGGC GTGGAGGTGCATAATGCCAAGACAAAGCCACGGGAGGAGC AGTTCAACAGCACGTTCCGTGTGGTCAGCGTCCTCACCGT CGTGCACCAGGACTGGCTGAACGGCAAGGAGTACAAGTGC AAGGTCTCCAACAAAGGCCTCCCAGCCCCCATCGAGAAAA |

| SEQ ID NOS: 343-538 | | |
|---|---|---|
| 534 | Human Heavy Chain Constant Region (IGHG2*06) Protein Sequence | CCArcrCCAAAACCAAAGGGCAGCCCCGAGAACCACAGGT<br>GTACACCTGCCCCCCATCCCGGAGGAGATGACCAAGAAC<br>CAGGTCAGCCTGACCTGCCTGGTCAAAGGCTTCTACCCCA<br>GCGACATCTCCGTGGAGTGGGAGAGCAATGGGCAGCCGGA<br>GAACAACTACAAGACCACACCTCCCATGCTGGACTCGAC<br>GGCTCCTTCTTCCTCTACAGCAAGCTCTTCATGCTCCGTGAT<br>GCAGGTGGCAGCAGGGGAACGTCTTCTCATGCTCCGTGAT<br>GCATGAGGCTCGCACAACCTACACAGAAGAGCCTC<br>TCCCTGTCTCCGGGTAAA<br>ASTKGPSVFPLAPCSRSTSESTAALGCLVKDYFPEPVTVS<br>WNSGALTSGVHTFPAVLQSSGLYSLSSVVTVPSSNFGTQT<br>YTCNVDHKPSNTKVDKTVERKCCVECPPCPAPPVAGPSVF<br>LFPPKPKDTLMISRTPEVTCVVVDVSHEDPEVQFNWYVDG<br>VEVHNAKTKPREEQFNSTFRVVSVLTVVHQDWLNGKEYKC<br>KVSNKGLPAPIEKTISKTKGQPREPQVYTLPPSREEMTKN<br>QVSLTCLVKGFYPSDISVEWESNGQPENNYKTTPPMLDSD<br>GSFFLYSKLTVDKSRWQQGNVFSCSVMHEALHNHYTQKSL<br>SLSPGK |
| 535 | Human Cλ constant region IGLC 7*03 | Cλ Light Chain Constant Region (IGLC7*03) Nucleotide Sequence | GGTCAGCCCAAGGCTGCCCCCTCGGTCACTCTGTTCCCAC<br>CCTCCTCTGAGGAGCTTCAAGCCAACAAGGCCACACTGGT<br>GTGTCTCGTAAGTGACTTCAACCCGGAGCCGTGACAGTG<br>GCCTGGAAGGCAGATGGCAGCCCGTCAAGGTGGGAGTGG<br>AGACCACCAAACCTCCAAAGCAACACAACAAGTATGC<br>GGCCAGCAGCTACCTGAGCCTGACGCCCAGCAGTGGAAG<br>TCCCAGAAGCTACAGCTGCGGGTCACGCATGAATGCTCT<br>GCACCGTGGAGAAGACAGTGGCCCCCTGCAGATGCTCT<br>GQPKAAPSVTLFPPSSEELQANKATLVCLVSDFNPGAVTV<br>AWKADGSPVKVGVETTKPSKQSNNKYAASSYLSLTPEQWK<br>SHRSYSCRVTHEGSTVEKTVAPAECS |
| 536 | | Cλ Light Chain Constant Region (IGLC7*03) Amino Acid Sequence | |
| 537 | Human WT IgG1 constant region IGHG 1*01 & IGHG 1*05 (IgG1) | WT human IgG1 nucleotide sequence #2 | gctctccaaggcccatggtctttccccctgcaccct<br>cctccaagagccctgggcacagcgcctgggctg<br>cctggtcaaggactactcccgaccagccggtgacggtcg<br>tggaactcaggcgcctgaccagcggcgtgcacacttcc<br>cggctgtccctacagtcctcaggactcttactccccgcag<br>cgtggcctgcctccccagcagcctgggcacccagacc<br>tacatctgcaacgtgaatcacaagcccagcaacaccaag<br>tggacaagaaagttgagccaaccccaaatcttgtgacaaaactca<br>cacatgcccaccgtgcccagcacctgaactcctgggggga<br>ccgtcagtcttcctcttccccccaaaacccaaggacaccc<br>tcatgatctcccggacccctgaggtcacatgcgtggtggt<br>ggacgtgagccacgaagaccctgaggtcaagttcaactgg<br>tacgtggacggcgtggaggtgcataatgccaagacaaagc<br>cgcgggaggagcagtacaacagcacgtaccgggtggtcag<br>cgtcctcaccgtcctgcaccaggactggctgaatggcaag<br>gagtacaagtgcaaggtctccaacaaagccctcccagcccc<br>ccatcgagaaaaccatctccaaagccaaagggcagccccg<br>agaaccacaggtgtacaccctgcccccatcccgggatgag<br>ctgaccaagaaccaggtcagcctgacctgcctggtcaaag |

TABLE S2-continued

| | | SEQ ID NOS: 343-538 | |
|---|---|---|---|
| 538 | Human Cλ constant region | IGLC 2*01 | Cλ Light Chain Constant Region Amino Acid Sequence #2 - Encoded by nucleotide sequence version A & B | gcttctatcccagcgacatcgccgtggagtgggagagcaa tgggcagccggagaacaactacaagaccacgcctcccgtg ctggactccgacagcgtcctcttcctctacagcaagctca ccgtgacaagagagcaggtgcagcagggaacgtcttctc atgctccgtgatgcatgaggctctgacaaccactacacg cagaagagcctctccctgtctccgggtaaa<br>GQPKAAPSVTLFPPSSEELQANKATLVCLISDFYPGAVTV AWKADSSPVKAGVETTPSKQSNNKYAASSYLSLTPEQWK SHRSYSCQVTHEGSTVEKTVAPTECS |

TABLE S3

| | SEQ ID NOS: 539-562 | |
|---|---|---|
| | hIgG1 FIT-Ig bispecific 1a | |
| Antibody A | anti-ICOS STIM003 | |
| Antibody B | anti-PD-L1 84G09 | Sequence |
| FIT-Ig Construct #1 | SEQ ID NO: 539 | DIQMTQSPASLSASLGETVTIQCRASEDIYSGLAWFQQKPGKSPQLLIYGASS LQDGVPSRFSGSGSGTQYSLKISSMQTEDEGVYFCQQGLKYPPTFGSGTKLEI KRTVAAPSVFIFPPSDEQLKSGTASVVCLLNNFYPREAKVQWKVDNALQSGNS QESVTEQDSKDSTYSLSSTLTLSKADYEKHKVYACEVTHQGLSSPVTKSFNRG ECEVQLVESGGGLTQPGKSLKLSCEASGFTFSSFTMHWVRQSPGKGLEWVAFI RSGSGIVFYADAVRGRFTISRDNAKNLLFLQMNDLKSEDTAMYYCARRPLGHN TFDSWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPSN TKVDKKVEPKSCDKTHTCPPCPAPELLGGPSVFLFPPKPKDTLMISRTPEVTC VVVDVSHEDPEVKFNWYVDGVEVHNAKTKPREEQYNSTYRVVSVLTVLHQDWL NGKEYKCKVSNKALPAPIEKTISKAKGQPREPQVYTLPPSRDELTKNQVSLTC LVKGFYPSDIAVEWESNGQPENNYKTTPPVLDSDGSFFLYSKLTVDKSRWQQG NVFSCSVMHEALHNHYTQKSLSLSPGK |
| FIT-Ig Construct #2 | SEQ ID NO: 540 | EVQLVESGGGLVQPGRSLKLSCAASGFTFSDFYMAWVRQAPKKGLEWVASISY EGSSTYYGDSVMGRFTISRDNAKSTLYLQMNSLRSEDTATYYCARQREANWED WGQGVMVTVSSASTKGPSVFPLAPSSKSTSGGTAALGCLVKDYFPEPVTVSWN SGALTSGVHTFPAVLQSSGLYSLSSVVTVPSSSLGTQTYICNVNHKPSNTKVD KKV |
| FIT-Ig Construct #3 | SEQ ID NO: 541 | DIVMTQSPSSLAVSPGEKVTMTCKSSQSLYYSGVKENLLAWYQQKPGQSPKLL IYYASIRFTGVPDRFTGSGSGTDYTLTITSVQAEDMGQYFCQQGINNPLTFGD GTKLEIKRTVAAPSVFIFPPSDEQLKSGTASVVCLLNNFYPREAKVQWKVDNA LQSGNSQESVTEQDSKDSTYSLSSTLTLSKADYEKHKVYACEVTHQGLSSPVT KSFNRGEC |
| | hIgG1 FIT-Ig bispecific 1b | |
| Antibody A | anti-ICOS 84G09 | |
| Antibody B | anti-ICOS STIM003 | |
| FIT-Ig Construct #1 | SEQ ID NO: 542 | DIVMTQSPSSLAVSPGEKVTMTCKSSQSLYYSGVKENLLAWYQQKPGQSPKLL IYYASIRFTGVPDRFTGSGSGTDYTLTITSVQAEDMGQYFCQQGINNPLTFGD GTKLEIKRTVAAPSVFIFPPSDEQLKSGTASVVCLLNNFYPREAKVQWKVDNA LQSGNSQESVTEQDSKDSTYSLSSTLTLSKADYEKHKVYACEVTHQGLSSPVT KSFNRGECEVQLVESGGGLVQPGRSLKLSCAASGFTFSDFYMAWVRQAPKKGL EWVASISYEGSSTYYGDSVMGRFTISRDNAKSTLYLQMNSLRSEDTATYYCAR QREANWEDWGQGVMVTVSSASTKGPSVFPLAPSSKSTSGGTAALGCLVKDYFP EPVTVSWNSGALTSGVHTFPAVLQSSGLYSLSSVVTVPSSSLGTQTYICNVNH KPSNTKVDKKVEPKSCDKTHTCPPCPAPELLGGPSVFLFPPKPKDTLMISRTP EVTCVVVDVSHEDPEVKFNWYVDGVEVHNAKTKPREEQYNSTYRVVSVLTVLH QDWLNGKEYKCKVSNKALPAPIEKTISKAKGQPREPQVYTLPPSRDELTKNQV SLTCLVKGFYPSDIAVEWESNGQPENNYKTTPPVLDSDGSFFLYSKLTVDKSR WQQGNVFSCSVMHEALHNHYTQKSLSLSPGK |
| FIT-Ig Construct #2 | SEQ ID NO: 543 | EVQLVESGGGLTQPGKSLKLSCEASGFTFSSFTMHWVRQSPGKGLEWVAFIRS GSGIVFYADAVRGRFTISRDNAKNLLFLQMNDLKSEDTAMYYCARRPLGHNTF DSWGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNTK VDKKV |
| FIT-Ig Construct #3 | SEQ ID NO: 544 | DIQMTQSPASLSASLGETVTIQCRASEDIYSGLAWFQQKPGKSPQLLIYGASS LQDGVPSRFSGSGSGTQYSLKISSMQTEDEGVYFCQQGLKYPPTFGSGTKLEI KRTVAAPSVFIFPPSDEQLKSGTASVVCLLNNFYPREAKVQWKVDNALQSGNS QESVTEQDSKDSTYSLSSTLTLSKADYEKHKVYACEVTHQGLSSPVTKSFNRG EC |
| | hIgG1 FIT-Ig bispecific 2a | |
| Antibody A | anti-ICOS STIM001 | |
| Antibody B | anti-PD-L1 1D05 | |
| FIT-Ig Construct #1 | SEQ ID NO: 545 | DIQMTQSPASLSASLGETVTIQCRASEDIYSGLAWFQQKPGKSPQLLIYGASS LQDGVPSRFSGSGSGTQYSLKISSMQTEDEGVYFCQQGLKYPPTFGSGTKLEI KRTDAAPTVSIFPPSSEQLTSGGASVVCFLNNFYPKDINVKWKIDGSERQNGV LNSWTDQDSKDSTYSMSSTLTLTKDEYERHNSYTCEATHKTSTSPIVKSFNRN ECEVQLVESGGGLTQPGKSLKLSCEASGFTFSSFTMHWVRQSPGKGLEWVAFI |

TABLE S3-continued

SEQ ID NOS: 539-562

| | | |
|---|---|---|
| | | RSGSGIVFYADAVRGRFTISRDNAKNLLFLQMNDLKSEDTAMYYCARRPLGHN<br>TFDSWGQGTLVTVSSAKTTAPSVYPLAPVCGDTTGSSVTLGCLVKGYFPEPVT<br>LTWNSGSLSSGVHTFPAVLQSDLYTLSSSVTVTSSTWPSQSITCNVAHPASST<br>KVDKKIEPRGPTIKPCPPCKCPAPNLLGGPSVFIFPPKIKDVLMISLSPIVTC<br>VVVDVSEDDPDVQISWFVNNVEVHTAQTQTHREDYNSTLRVVSALPIQHDWM<br>SGKEFKCKVNNKDLPAPIERTISKPKGSVRAPQVYVLPPPEEEMTKKQVTLTC<br>MVTDFMPEDIYVEWTNNGKTELNYKNTEPVLDSDGSYFMYSKLRVEKKNWVER<br>NSYSCSVVHEGLHNHHTTKSFSRTPGK |
| FIT-Ig<br>Construct #2 | SEQ ID NO:<br>546 | EVQLVESGGGLVQPGRSLKLSCAASGFTFSDFYMAWVRQAPKKGLEWVASISY<br>EGSSTYYGDSVMGRFTISRDNAKSTLYLQMNSLRSEDTATYYCARQREANWED<br>WGQGVMVTVSSAKTTAPSVYPLAPVCGDTTGSSVTLGCLVKGYFPEPVTLTWN<br>SGSLSSGVHTFPAVLQSDLYTLSSSVTVTSSTWPSQSITCNVAHPASSTKVDK<br>KI |
| FIT-Ig<br>Construct #3 | SEQ ID NO:<br>547 | DIVMTQSPSSLAVSPGEKVTMTCKSSQSLYYSGVKENLLAWYQQKPGQSPKLL<br>IYYASIRFTGVPDRFTGSGSGTDYTLTITSVQAEDMGQYFCQQGINNPLTFGD<br>GTKLEIKRTDAAPTVSIFPPSSEQLTSGGASVVCFLNNFYPKDINVKWKIDGS<br>ERQNGVLNSWTDQDSKDSTYSMSSTLTLTKDEYERHNSYTCEATHKTSTSPIV<br>KSFNRNEC | hIgG1 FIT-Ig bispecific 2b

| | | |
|---|---|---|
| Antibody A | anti-PD-L1<br>1D05 | |
| Antibody B | anti-ICOS<br>STIM001 | |
| FIT-Ig<br>Construct #1 | SEQ ID NO:<br>548 | DIVMTQSPSSLAVSPGEKVTMTCKSSQSLYYSGVKENLLAWYQQKPGQSPKLL<br>IYYASIRFTGVPDRFTGSGSGTDYTLTITSVQAEDMGQYFCQQGINNPLTFGD<br>GTKLEIKRTDAAPTVSIFPPSSEQLTSGGASVVCFLNNFYPKDINVKWKIDGS<br>ERQNGVLNSWTDQDSKDSTYSMSSTLTLTKDEYERHNSYTCEATHKTSTSPIV<br>KSFNRNECEVQLVESGGGLVQPGRSLKLSCAASGFTFSDFYMAWVRQAPKKGL<br>EWVASISYEGSSTYYGDSVMGRFTISRDNAKSTLYLQMNSLRSEDTATYYCAR<br>QREANWEDWGQGVMVTVSSAKTTAPSVYPLAPVCGDTTGSSVTLGCLVKGYFP<br>EPVTLTWNSGSLSSGVHTFPAVLQSDLYTLSSSVTVTSSTWPSQSITCNVAHP<br>ASSTKVDKKIEPRGPTIKPCPPCKCPAPNLLGGPSVFIFPPKIKDVLMISLSP<br>IVTCVVVDVSEDDPDVQISWFVNNVEVHTAQTQTHREDYNSTLRVVSALPIQH<br>QDWMSGKEFKCKVNNKDLPAPIERTISKPKGSVRAPQVYVLPPPEEEMTKKQV<br>TLTCMVTDFMPEDIYVEWTNNGKTELNYKNTEPVLDSDGSYFMYSKLRVEKKN<br>WVERNSYSCSVVHEGLHNHHTTKSFSRTPGK |
| FIT-Ig<br>Construct #2 | SEQ ID NO:<br>549 | EVQLVESGGGLTQPGKSLKLSCEASGFTFSSFTMHWVRQSPGKGLEWVAFIRS<br>GSGIVFYADAVRGRFTISRDNAKNLLFLQMNDLKSEDTAMYYCARRPLGHNTF<br>DSWGQGTLVTVSSAKTTAPSVYPLAPVCGDTTGSSVTLGCLVKGYFPEPVTLT<br>WNSGSLSSGVHTFPAVLQSDLYTLSSSVTVTSSTWPSQSITCNVAHPASSTKV<br>DKKI |
| FIT-Ig<br>Construct #3 | SEQ ID NO:<br>550 | DIQMTQSPASLSASLGETVTIQCRASEDIYSGLAWFQQKPGKSPQLLIYGASS<br>LQDGVPSRFSGSGSGTQYSLKISSMQTEDEGVYFCQQGLKYPPTFGSGTKLEI<br>KRTDAAPTVSIFPPSSEQLTSGGASVVCFLNNFYPKDINVKWKIDGSERQNGV<br>LNSWTDQDSKDSTYSMSSTLTLTKDEYERHNSYTCEATHKTSTSPIVKSFNRN<br>EC | hIgG1 FIT-Ig bispecific 3a

| | | |
|---|---|---|
| Antibody A | anti-ICOS<br>STIM003 | |
| Antibody B | anti-PD-L1<br>1D05 | |
| FIT-Ig<br>Construct #1 | SEQ ID NO:<br>551 | DIQMTQSPASLSASLGETVTIQCRASEDIYSGLAWFQQKPGKSPQLLIYGASS<br>LQDGVPSRFSGSGSGTQYSLKISSMQTEDEGVYFCQQGLKYPPTFGSGTKLEI<br>KRTVAAPSVFIFPPSDEQLKSGTASVVCLLNNFYPREAKVQWKVDNALQSGNS<br>QESVTEQDSKDSTYSLSSTLTLSKADYEKHKVYACEVTHQGLSSPVTKSFNRG<br>ECEVQLVESGGGLTQPGKSLKLSCEASGFTFSSFTMHWVRQSPGKGLEWVAFI<br>RSGSGIVFYADAVRGRFTISRDNAKNLLFLQMNDLKSEDTAMYYCARRPLGHN<br>TFDSWGQGTLVTVSSASTKGPSVFPLAPSSKSTSGGTAALGCLVKDYFPEPVT<br>VSWNSGALTSGVHTFPAVSSGLYSLSSVVTVPSSSLGTQTYICNVNHKPSN<br>TKVDKKVEPKSCDKTHTCPPNLLGGPSVFIFPPKIKDVLMISLSPIVTCVVVD<br>VSEDDPDVQISWFVNNVEVHTAQTQTHREDYNSTLRVVSALPIQHDWMSGKE<br>FKCKVNNKDLPAPIERTISKPKGSVRAPQVYVLPPPEEEMTKKQVTLTCMVTD<br>FMPEDIYVEWTNNGKTELNYKNTEPVLDSDGSYFMYSKLRVEKKNWVERNSYS<br>CSVVHEGLHNHHTTKSFSRTPGK |

TABLE S3-continued

SEQ ID NOS: 539-562

| FIT-Ig Construct #2 | SEQ ID NO: 552 | EVQLVESGGGLVQPGRSLKLSCAASGFTFSDFYMAWVRQAPKKGLEWVASISY EGSSTYYGDSVMGRFTISRDNAKSTLYLQMNSLRSEDTATYYCARQREANWED WGQGVMVTVSSASTKGPSVFPLAPSSKSTSGGTAALGCLVKDYFPEPVTVSWN SGALTSGVHTFPAVLQSSGLYSLSSVVTVPSSSLGTQTYICNVNHKPSNTKVD KKV |
| --- | --- | --- |
| FIT-Ig Construct #3 | SEQ ID NO: 553 | DIVMTQSPSSLAVSPGEKVTMTCKSSQSLYYSGVKENLLAWYQQKPGQSPKLL IYYASIRFTGVPDRFTGSGSGTDYTLTITSVQAEDMGQYFCQQGINNPLTFGD GTKLEIKRTVAAPSVFIFPPSDEQLKSGTASVVCLLNNFYPREAKVQWKVDNA LQSGNSQESVTEQDSKDSTYSLSSTLTLSKADYEKHKVYACEVTHQGLSSPVT KSFNRGEC | hIgG1 FIT-Ig bispecific 3b

| Antibody A | anti-PD-L1 1D05 | |
| --- | --- | --- |
| Antibody B | anti-ICOS STIM003 | |
| FIT-Ig Construct #1 | SEQ ID NO: 554 | DIVMTQSPSSLAVSPGEKVTMTCKSSQSLYYSGVKENLLAWYQQKPGQSPKLL IYYASIRFTGVPDRFTGSGSGTDYTLTITSVQAEDMGQYFCQQGINNPLTFGD GTKLEIKRTVAAPSVFIFPPSDEQLKSGTASVVCLLNNFYPREAKVQWKVDNA LQSGNSQESVTEQDSKDSTYSLSSTLTLSKADYEKHKVYACEVTHQGLSSPVT KSFNRGECEVQLVESGGGLVQPGRSLKLSCAASGFTFSDFYMAWVRQAPKKGL EWVASISYEGSSTYYGDSVMGRFTISRDNAKSTLYLQMNSLRSEDTATYYCAR QREANWEDWGQGVMVTVSSASTKGPSVFPLAPSSKSTSGGTAALGCLVKDYFP EPVTVSWNSGALTSGVHTFPAVLQSSGLYSLSSVVTVPSSSLGTQTYICNVNH KPSNTKVDKKVEPKSCDKTHTCPPNLLGGPSVFIFPPKIKDVLMISLSPIVTC VVVDVSEDDPDVQISWFVNNVEVHTAQTQTHREDYNSTLRVVSALPIQHQDWM SGKEFKCKVNNKDLPAPIERTISKPKGSVRAPQVYVLPPPEEEMTKKQVTLTC MVTDFMPEDIYVEWTNNGKTELNYKNTEPVLDSDGSYFMYSKLRVEKKNWVER NSYSCSVVHEGLHNHHTTKSFSRTPGK |
| FIT-Ig Construct #2 | SEQ ID NO: 555 | EVQLVESGGGLTQPGKSLKLSCEASGFTFSSFTMHWVRQSPGKGLEWVAFIRS GSGIVFYADAVRGRFTISRDNAKNLLFLQMNDLKSEDTAMYYCARRPLGHNTF DSWGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNTK VDKKV |
| FIT-Ig Construct #3 | SEQ ID NO: 556 | DIQMTQSPASLSASLGETVTIQCRASEDIYSGLAWFQQKPGKSPQLLIYGASS LQDGVPSRFSGSGSGTQYSLKISSMQTEDEGVYFCQQGLKYPPTFGSGTKLEI KRTVAAPSVFIFPPSDEQLKSGTASVVCLLNNFYPREAKVQWKVDNALQSGNS QESVTEQDSKDSTYSLSSTLTLSKADYEKHKVYACEVTHQGLSSPVTKSFNRG EC | hIgG1 FIT-Ig bispecific 4a

| Antibody A | anti-ICOS STIM001 | |
| --- | --- | --- |
| Antibody B | anti-PD-L1 84G09 | |
| FIT-Ig Construct #1 | SEQ ID NO: 557 | DIQMTQSPASLSASLGETVTIQCRASEDIYSGLAWFQQKPGKSPQLLIYGASS LQDGVPSRFSGSGSGTQYSLKISSMQTEDEGVYFCQQGLKYPPTFGSGTKLEI KRTVAAPSVFIFPPSDEQLKSGTASVVCLLNNFYPREAKVQWKVDNALQSGNS QESVTEQDSKDSTYSLSSTLTLSKADYEKHKVYACEVTHQGLSSPVTKSFNRG ECEVQLVESGGGLTQPGKSLKLSCEASGFTFSSFTMHWVRQSPGKGLEWVAFI RSGSGIVFYADAVRGRFTISRDNAKNLLFLQMNDLKSEDTAMYYCARRPLGHN TFDSWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPSN TKVDKKVEPKSCDKTHTCPPNLLGGPSVFIFPPKIKDVLMISLSPIVTCVVVD VSEDDPDVQISWFVNNVEVHTAQTQTHREDYNSTLRVVSALPIQHQDWMSGKE FKCKVNNKDLPAPIERTISKPKGSVRAPQVYVLPPPEEEMTKKQVTLTCMVTD FMPEDIYVEWTNNGKTELNYKNTEPVLDSDGSYFMYSKLRVEKKNWVERNSYS CSVVHEGLHNHHTTKSFSRTPGK |
| FIT-Ig Construct #2 | SEQ ID NO: 558 | EVQLVESGGGLVQPGRSLKLSCAASGFTFSDFYMAWVRQAPKKGLEWVASISY EGSSTYYGDSVMGRFTISRDNAKSTLYLQMNSLRSEDTATYYCARQREANWED WGQGVMVTVSSASTKGPSVFPLAPSSKSTSGGTAALGCLVKDYFPEPVTVSWN SGALTSGVHTFPAVLQSSGLYSLSSVVTVPSSSLGTQTYICNVNHKPSNTKVD KKV |
| FIT-Ig Construct #3 | SEQ ID NO: 559 | DIVMTQSPSSLAVSPGEKVTMTCKSSQSLYYSGVKENLLAWYQQKPGQSPKLL IYYASIRFTGVPDRFTGSGSGTDYTLTITSVQAEDMGQYFCQQGINNPLTFGD GTKLEIKRTVAAPSVFIFPPSDEQLKSGTASVVCLLNNFYPREAKVQWKVDNA LQSGNSQESVTEQDSKDSTYSLSSTLTLSKADYEKHKVYACEVTHQGLSSPVT KSFNRGEC |

TABLE S3-continued

SEQ ID NOS: 539-562 hIgG1 FIT-Ig bispecific 4b

| | | |
|---|---|---|
| Antibody A | anti-PD-L1 84G09 | |
| Antibody B | anti-ICOS STIM001 | |
| FIT-Ig Construct #1 | SEQ ID NO: 560 | DIVMTQSPSSLAVSPGEKVTMTCKSSQSLYYSGVKENLLAWYQQKPGQSPKLL IYYASIRFTGVPDRFTGSGSGTDYTLTITSVQAEDMGQYFCQQGINNPLTFGD GTKLEIKRTVAAPSVFIFPPSDEQLKSGTASVVCLLNNFYPREAKVQWKVDNA LQSGNSQESVTEQDSKDSTYSLSSTLTLSKADYEKHKVYACEVTHQGLSSPVT KSFNRGECEVQLVESGGGLVQPGRSLKLSCAASGFTFSDFYMAWVRQAPKKGL EWVASISYEGSSTYYGDSVMGRFTISRDNAKSTLYLQMNSLRSEDTATYYCAR QREANWEDWGQGVMVTVSSASTKGPSVFPLAPSSKSTSGGTAALGCLVKDYFP EPVTVSWNSGALTSGVHTFPAVLQSSGLYSLSSVVTVPSSSLGTQTYICNVNH KPSNTKVDKKVEPKSCDKTHTCPPNLLGGPSVFIFPPKIKDVLMISLSPIVTC VVVDVSEDDPDVQISWFVNNVEVHTAQTQTHREDYNSTLRVVSALPIQHQDWM SGKEFKCKVNNKDLPAPIERTISKPKGSVRAPQVYVLPPPEEEMTKKQVTLTC MVTDFMPEDIYVEWTNNGKTELNYKNTEPVLDSDGSYFMYSKLRVEKKNWVER NSYSCSVVHEGLHNHHTTKSFSRTPGK |
| FIT-Ig Construct #2 | SEQ ID NO: 561 | EVQLVESGGGLTQPGKSLKLSCEASGFTFSSFTMHWVRQSPGKGLEWVAFIRS GSGIVFYADAVRGRFTISRDNAKNLLFLQMNDLKSEDTAMYYCARRPLGHNTF DSWGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNTK VDKKV |
| FIT-Ig Construct #3 | SEQ ID NO: 562 | DIQMTQSPASLSASLGETVTIQCRASEDIYSGLAWFQQKPGKSPQLLIYGASS LQDGVPSRFSGSGSGTQYSLKISSMQTEDEGVYFCQQGLKYPPTFGSGTKLEI KRTVAAPSVFIFPPSDEQLKSGTASVVCLLNNFYPREAKVQWKVDNALQSGNS QESVTEQDSKDSTYSLSSTLTLSKADYEKHKVYACEVTHQGLSSPVTKSFNRG EC |

TABLE S4

Sequences of antibody heavy chain variable regions obtained from additional clones CDRs are defined according to IMGT.

| CLONE_ID | VH_NUCLEOTIDE_SEQUENCE | VH_AMINO_ACID_SEQ | HCDR1 | HCDR2 | HCDR3 |
|---|---|---|---|---|---|
| CL-61091 | CAGGTTCAACTGATGCAGTCTGGAACTGAGTGAAGAAGCCTGGGG CCTCAGTGAAGGTCTCCTGCAAGACTTCTGGTTACACCTTTACCAC CTATGGTATCACTTGGGTGCGACAGGCCCCTGGACAAGGGCTTGAG TGGATGGGATGGATCAGCGCTTACAGTGGTGACACAGATGCAC AGAAGTTCCAGGGCAGAGTCACCATGACCACAGACACATCCACGAA CACAGCCTACATGGAGCTGAGTAGTCTGCGCCCCACTACGGTA GTGTATTATTGTGCGAGAGTAGTGGCTGCCCCACTACGGTA TGGACGTCTGGGGCCAAGGGACCACGGTCACCGTCTCCTCAG SEQ ID NO: 563 | QVQLMQSGTEVKKPGASV KVSCKTSGYTFTTYGITW VRQAPDGQGLEWMGWISAY SGDTDYAQKFQGRVTVTT DTSTNTAYMELRSLKSDD TAVYYCARSSGWPHHYGM DVWGQGTTVTVSS SEQ ID NO: 564 | GYTFTTYG SEQ ID NO: 565 | ISAYSGDT SEQ ID NO: 566 | ARSSGWPHHYGMDV SEQ ID NO: 567 |
| CL-64536 | CAGGTTCAACTGGTGCAGTCTGGAGGTGAGGTGAAAAAGCCTGGGG CCTCAGTGAAGGTCTCCTGCAAGGCTTCTGGTTACACCTTTACCAG CTATGGTTTCAGCTGGGTGCGACAGGCCCCTGGACAAGGGCTTGAG TGGATGGGATGGATCAGCGCTTACAATGGTAACACAAACTATGCAC AGAAGCTCCAGGGCAGAGTCACCATGACCACAGACACATCCACGAG CACAGCCTACATGGAGCTGAGGAGCCTTGAGATCTGACGACGGCC GTGTATTTCTGTGCCGATCACGTCTTACTACTATGGTTCGGGACCC TATACGGTATGGACGTCTGGGGCCAAGGGACCACCGGTCACCGTCTC CTCAG SEQ ID NO: 568 | QVQLVQSGGEVKKPGASV KVSCKASGYTFTSYGFSW VRQAPGQGLEWMGWISAY NGNTNYAQKLQGRVSMTT DTSTSTAYMELRSLRSDD TAVYFCARSTSYYGSGTL YGMDVWGQGTTVTVSS SEQ ID NO: 569 | GYTFTSYG SEQ ID NO: 377 | ISAYNGNT SEQ ID NO: 378 | ARSTSYYGSGTLYGMDV SEQ ID NO: 570 |
| CL-64837 | CAGGTTCAACTGGTGCAGTCTGGAGGTGAGGTGAAGAAGCCTGGGG CCTCAGTGAAGGTTTCAGCTGTCCTGCAAGGCTTCTGGTTACACCTTTACCAG CTATGGTTTCAGCTGGGTGCGACAGGCCCCTGGACAAGGACTAGAG TGGATGGGATGGATCAGCGCTTACAATGGTAACACAAACTATGCAC AGAAGCTCCAGGGCAGAGTCACCATGACCACAGACACATCCACGAG CACAGCCTACATGGAGCTGAGGAGCTTGAGATCTGACGACGGCC GTGTATTACTGTGCCGCATCACGTCTTACTACTATGGTTCGGGACCC TCTACGGGTATGGACGTCTGGGGCCAAGGGACCACCGGTCACCGTCTC CTCAG SEQ ID NO: 571 | QVQLVQSGGEVKKPGASV KVSCKASGYTFTSYGFSW VRQAPGQGLEWMGWISAY NGNTNYAQKLQGRVSMTT DTSTSTAYMELRSLRSDD TAVYYCARSTSYYGSGTL YGMDVWGQGTTVTVSS SEQ ID NO: 572 | GYTFTSYG SEQ ID NO: 377 | ISAYNGNT SEQ ID NO: 378 | ARSTSYYGSGTLYGMDV SEQ ID NO: 570 |
| CL-64841 | CAGGTTCAACTGGTGCAGTCTGGAGGTGAGGTGAAAAAGCCTGGGG CCTCAGTGAAGGTCTCCTGCAAGGCTTCTGGTTACACCTTTACCAG CTATGGTTTCAGCTGGGTGCGACAGGCCCCTGGACAAGGACTAGAG TGGATGGGATGGATCAGCGCTTACAATGGTAACACAAACTATGCAC AGAAGCTCCAGGGCAGAGTCACCATGACCACAGACACATCCACGAG CACAGCCTACATGGAGCTGAGGAGCTTGAGATCTGACGACGGCC GTGTATTTCTGTGCCGCATCACGTCTTACTACTATGGTTCGGGACCC TCTACGGGTATGGACGTCTGGGGCCAAGGGACCACCGGTCACCGTCTC CTCAG SEQ ID NO: 573 | QVQLVQSGGEVKKPGASV KVSCKASGYTFTSYGFSW VRQAPGQGLEWMGWISAY NGNTNYAQKLQGRVSMTT DTSTSTAYMELRSLRSDD TAVYFCARSTSYYGSGTL YGMDVWGQGTTVTVSS SEQ ID NO: 574 | GYTFTSYG SEQ ID NO: 377 | ISAYNGNT SEQ ID NO: 378 | ARSTSYYGSGTLYGMDV SEQ ID NO: 570 |
| CL-64912 | CAGGTTCAACTGGTGCAGTCTGGAGGTGAGGTGAAAAAGCCTGGG CCTCAGTGAAGGTCTCCTGCAAGGCTTCTGGTTACACCTTTACCAG CTATGTGTTCAGCTGGGTGCGACATGCCGCTGGACAAGGACTAGAG | QVQLVQSGGEVKKPRASV KVSCKASGYTFTSYVFSW VRHAAGQGLEWMGWISGY | GYTFTSYV SEQ ID NO: 577 | ISGYNGNT SEQ ID NO: 578 | ARSTSYYGAGTLYGMDV SEQ ID NO: 579 |

TABLE S4-continued

Sequences of antibody heavy chain variable regions obtained from additional clones CDRs are defined according to IMGT.

| CLONE_ID | VH_NUCLEOTIDE_SEQUENCE | VH_AMINO_ACID_SEQ | HCDR1 | HCDR2 | HCDR3 |
|---|---|---|---|---|---|
| | TGGATGGGATGGGATCAGCGTTACAATGTAACAAACTATGCAC AGAAGCTCCAGTGCGGAGTCTGATGACCGCAGACACATCCACGAG CACAGCCTACATGGAGCTGAGGAGCTTGAGATCTGACGACACGGCC GTGTATTTCTGTGCGCGATCTACGTCTTACTATGTGCGGGACCC TATACGGTATGGACGTCTGGGGCCAAGGGACCACCGTCACCGTCTC CTCAG SEQ ID NO: 575 | NGNTNYAQKLQCGVSMTA DTSTSTAYMELRSLRSDD TAVYFCARSTSYYGAGTL YGMDVWGQGTTVTVSS SEQ ID NO: 576 | | | |
| CL-71642 | GAGGTGCAGCTGGTGGAGTCTGGGGGAGGTGTGGTACGCCTGGGG GGTCCCTGAGACTCTCCTGTGCAGCCTCTGGATTCACCTTTGATGA TTATGGCATGAGCTGGGTCCGCCAAGCTCCAGGGAAGGGGCTGGAG TGGGTCTCTGGTATTAATTGGAATGGTGGTAGCACAGGTTATGCAG ACTCTGTGAAGGGCCGATTCACCATCTCCAGAGACAACGCCAAGAA CTCCCTGTATCTGCAAATGAACAGTCTGAGAGCCGAGGACACGGCC TTGTATTACTGTGCGCCGATTACTATGGTTCGGGGAGTTATTATA ACGTCCCCTTTGACTACTGGGGCCAGGGAACCCTGGTCACCGTCTC CTCAG SEQ ID NO: 580 | EVQLVESGGGVVRPGGSL RLSCAASGFTFDDYGMSW VRQAPGKGLEWVSGINWN GGSTGYADSVKGRFTISR DNAKNSLYLQMNSLRAED TALYYCAADYYGSGSYYN VPFDYWGQGTLVTVSS SEQ ID NO: 581 | GFTFDDYG SEQ ID NO: 582 | INWNGGST SEQ ID NO: 583 | AADYYGSGSYYNVPFDY SEQ ID NO: 584 |
| CL-74570 | GAGGTGCAGCTGGTGGAGTCTGGGGGAGGTGTGATACGGCCTGGGG GGTCCCTGAGACTCTCCTGTGCAGCCTCTGGATTCACCTTTGATGA TTATGGCATGAGCTGGGTCCGCCAAGCTCCAGGGAAGGGGCTGGAG TGGGTCTCTGGTATTAATTGGATTGGTGATAACACAGATTATGCAG ACTCTGTGAAGGGCCGATTCACCATCTCCAGAGACAACGCCAAGAA CTCCCTATATCTGCAAATGAACAGTCTGAGAGCCGAGGACACGGCC TTGTATTACTGTGCGAGAGATTACTTTGGTTCGGGGAGTTATTATA ACGTTCCCTTTGACTACTGGGGCCAGGGAACCCTGGTCACCGTCTC CTCAG SEQ ID NO: 585 | EVQLVESGGGVIRPGGSL RLSCAASGFTFDDYGMSW VRQAPGKGLEWVSGINWI GDNTYADSVKGRFTISR DNAKNSLYLQMNSLRAED TALYYCARDYFGSGSYYN VPFDYWGQGTLVTVSS SEQ ID NO: 586 | GFTFDDYG SEQ ID NO: 582 | INWIGDNT SEQ ID NO: 587 | ARDYFGSGSYYNVPFDY SEQ ID NO: 588 |

TABLE S5

Sequences of antibody light chain variable regions obtained from additional clones
N terminal E and 5' nucleotide additions in CL-71642 are shown in bold. These were not recovered in sequencing but were
determined to be present in the sequence by comparison against the related clones as shown in FIG 36. CDRs are defined
according to IMGT.

| CLONE_ID | VL_NUCLEOTIDE_SEQUENCE | VL_AMINO_ACID_SEQ | LCDR1 | LCDR2 | LCDR3 |
|---|---|---|---|---|---|
| CL-61091 | GATATTGTGATGACTCAGTCTCCACTCTCCCTGCCCGTCACCCCTG GAGAGCCGGCCTCCATCTCCTGCAGGTCTAGTCAGAGCCTCCTGCA TAGTAATGGATTCAACTATTTGAATTGGTACCTGCAGAAGCCAGGA CAGTCTCCACAGCTCCTGATCTTTTTGGTTTCTAATCGGGCCTCCG GGGTCCCTGACAGGTTCAGTGGCAGTGGATCAGGCACAGATTTTAC ACTGAAAATCAGCAGAGTGAGGCTGAAGATGTTGGGATTTATTAC TGCATGCAAGCTCTACAAACTCCGCTCACTTTCGGCGGAGGGACCA AGGTGGAGATCAAAC SEQ ID NO: 589 | DIVMTQSPLSLPVTPGEPA SISCRSSQSLLHSNGFNY DWYLQKPGQSPQLLIFLVS NRASGVPDRFSGSGSGTDF TLKISRVEAEDVGIYYCMQ ALQTPLIFGGGTKVEIK SEQ ID NO: 590 | QSLLHSNGFNY SEQ ID NO: 591 | INS SEQ ID NO: 592 | MQALQTPLT SEQ ID NO: 593 |
| CL-64536 | GATATTGTGATGACTCAGTCTCCACTCTCCCTGCCCGTCACCCCTG GAGAGCCGGCCTCCATCTCCTGCAGGTCTAGTCAGAGCCTCCTGCA TAGTAATGGATACAACTGTTTGGATTGGTACCTGCAGAAGCCAGGG CAGTCTCCACAGCTCCTGATCTATTTGGGTTCTACTGGGCCTCCG GGTTCCCTGACAGGTTCAGTGGCAGTGGATCAGGCACAGATTTTAC ACTGAAAATCAGCAGAGTGAGGCTGAAGATGTTGGGTTTATTAC TGCATGCAAGCTCTACAAACTCCGTGCAGTTTTGGCCAGGGGACCA AGCTGGAGATCAAAC SEQ ID NO: 594 | DIVMTQSPLSLPVTPGEPA SISCRSSQSLLHSNGYNCL DWYLQKPGQSPQLLIYLGS TRASGFPDRFSGSGSGTDF TLKISRVEAEDVGVYYCMQ ALQTPCSFGQGTKLEIK SEQ ID NO: 595 | QSLLHSNGYNC SEQ ID NO: 596 | IGS SEQ ID NO: 371 | MQALQTPCS SEQ ID NO: 400 |
| CL-64837 | GATATTGTGATGACTCAGTCTCCACTCTCCCTGCCCGTCACCCCTG GAGAGCCGGCCTCCATCTCCTGCAGGTCTAGTCAGAGCCTCCTGCA TAGTAATGGATACAACTGTTTGGATTGGTACCTGCAGAAGCCAGGG CAGTCTCCACAGCTCCTGATCTATTTGGGTTCTACTGGGCCTCCG GGTTCCCTGACAGGTTCAGTGGCAGTGGATCAGGCACAGATTTTAC ACTGAAAATCAGCAGAGTGAGGCTGAAGATGTTGGGTTTATTAC TGCATGCAAGCTCTACAAACTCCGTGCAGTTTTGGCCAGGGGACCA AGCTGGAGATCAAAC SEQ ID NO: 597 | DIVMTQSPLSLPVTPGEPA SISCRSSQSLLHSNGYNCL DWYLQKPGQSPQLLIYLGS TRASGFPDRFSGSGSGTDF TLKISRVEAEDVGVYYCMQ ALQTPCSFGQGTKLEIK SEQ ID NO: 598 | QSLLHSNGYNC SEQ ID NO: 596 | IGS SEQ ID NO: 371 | MQALQTPCS SEQ ID NO: 400 |
| CL-64841 | GATATTGTGATGACTCAGTCTCCACTCTCCCTGCCCGTCACCCCTG GAGAGCCGGCCTCCATCTCCTGCAGGTCTAGTCAGAGCCTCCTGCA TAGTAATGGATACAACTGTTTGGATTGGTACCTGCAGAAGCCAGGG CAGTCTCCACAGCTCCTGATCTATTTGGGTTCTACTGGGCCTCCG GGTTCCCTGACAGGTTCAGTGGCAGTGGATCAGGCACAGATTCTAC ACTGAAAATCAGCAGAGTGAGGCTGAAGATGTTGGGAGTTATTAC TGCATGCAAGCTCTACAAACTCCGTGCAGTTTTGGCCAGGGGACCA AGCTGGAGATCAAAC SEQ ID NO: 599 | DIVMTQSPLSLPVTPGEPA SISCRSSQSLLHSNGYNCL DWYLQKPGQSPQLLIYLGS TRASGFPDRFSGSGSGTDS TLKISRVEAEDVGVYYCMQ ALQTPCSFGQGTKLEIK SEQ ID NO: 600 | QSLLHSNGYNC SEQ ID NO: 596 | IGS SEQ ID NO: 371 | MQALQTPCS SEQ ID NO: 400 |
| CL-64912 | GATATTGTGATGACTCAGTCTCCACTCTCCCTGCCCGTCACCCCTG GAGAGCCGGCCTCCATCTCCTGCAGGTCTAGTCAGAGCCTCCTGCA TAGTAATGGATACAACTGTTTGGATTGGTACCTGCAGAAGCCAGGG CAGTCTCCACAGCTCCTGATCTATTTGGGTTCTACTGGGCCTCCG | DIVMTQSPLSLPVTPGEPA SISCRSSQSLLHSNGYNCL DWYLQKPGQSPQLLIYLGS TRASGFPDRFSGSGSGTDF | QSLLHSNGYNC SEQ ID NO: 596 | IGS SEQ ID NO: 371 | MQALQTPCS SEQ ID NO: 400 |

TABLE S5-continued

Sequences of antibody light chain variable regions obtained from additional clones
N terminal E and 5' nucleotide additions in CL-71642 are shown in bold. These were not recovered in sequencing but were determined to be present in the sequence by comparison against the related clones as shown in FIG 36. CDRs are defined according to IMGT.

| CLONE_ID | VL_NUCLEOTIDE_SEQUENCE | VL_AMINO_ACID_SEQ | LCDR1 | LCDR2 | LCDR3 |
|---|---|---|---|---|---|
| | GGTTCCCTGACAGGTTCAGTGGCAGTGGATCAGGCACAGATTTTAC ACTGAAAATCAGCAGAGTGGAGGCTGAGGATGTTGGGGTTTATTAC TGCATGCAAGCTCTACAAACTCCGTGCAGTTTTGCCAGGGGACCA AGCTGGAGATCAAAC SEQ ID NO: 601 | TLKISRVEAEDVGVYYCMQ ALQTPCSFGQGTKLEIK SEQ ID NO: 602 | | | |
| CL-71642 | GAAATTGTGTTGACCAGTCTCCAGGCACCCTGTCTTTGTCTCCAG GGGAAAGAGCCACCCTCTCCTGCAGGGCCAGTCAGAGTGTTAGCAG CAGCTACTTAGCCTGTACCAGCAGAAACCTGGCCAGGCTCCCAGG CTCCTCATCTATGGTGCATCCAGCAGGGCCACTGGCATCCCAGACA GGTTCAGTGGCAGTGGGTCTGGGACAGACTTCACTCTCACCATCAG CAGACTGGAGCCTGAAGATTTTGCAGTGTATTACTGTCAGCAGTAT GGTAGCTCACCTTTCACTTTCGGCCCTGGGACCAAAGTGGATATCA AAC SEQ ID NO: 603 | EIVLTQSPGTLSLSPGERA TLSCRASQSVSSSYLAWYQ QKPGQAPRLLIYGASSRAT GIPDRFSGSGSGTDFTLTI SRLEPEDFAVYYCQQYGSS PFTFGPGTKVDIK SEQ ID NO: 604 | QSVSSSY SEQ ID NO: 426 | GAS SEQ ID NO: 413 | QQYGSSPFT SEQ ID NO: 605 |
| CL-74570 | GAAATTGTGTTGACCAGTCTCCAGGCACCCTGTCTTTGTCTCCAG GGGAAAGAGCCACCCTCTCCTGCAGGGCCAGTCAGAGTGTTAGCAG CAGCTACTTAGCCTGGTACCAGCAGAAACCTGGCCAGGCTCCCAGG CTCCTCATCTATGGTGCATCCAGCAGGGCCACTGGCATCCCAGACA GGTTCAGTGGCAGTGGGTCTGGGACAGACTTCACTCTCACCATCAG CAGACTGGAACCTGAAGATTTGCAGTATATTACTGTCACCAGTAT GGTAATTCACCATTCACTTTCGGCCCCTGGGACCAAAGTGGATATCA AAC SEQ ID NO: 606 | EIVLTQSPGTLSLSPGERA TLSCRASQSVSSSYLAWYQ QKPGQAPRLLIYGASSRAT GIPDRFSGSGSGTDFTLTI SRLEPEDFAVYYCHQYGNS PFTFGPGTKVDIK SEQ ID NO: 607 | QSVSSSY SEQ ID NO: 426 | GAS SEQ ID NO: 413 | HQYGNSPFT SEQ ID NO: 608 |

SEQUENCE LISTING (610 sequences)

SEQ ID NO: 1 - protein, 290 aa, Homo Sapiens
MRIFAVFIFMTYWHLLNAFTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERTHLVILGAILLCLGVALTFIFRLRKGRMMDVKKCGIQDTNSKKQSDTHLEET

SEQ ID NO: 2 - protein, 241 aa, Cynomologus
MGWSCIILFLVATATGVHSMFTVTVPKDLYVVEYGSNMTIECKFPVEKQLDLTSLIVYWEMEDKNIIQFVHGEEDLKVQHSNYRQRAQLLKDQLSLGNAALRITDVKLQDAGVYRCMISYGGADYKRITVKVNAPYNKINQRILVVDPVTSEHELTCQAEGYPKAEVIWTSSDHQVLSGKTTTTNSKREEKLLNVTSTLRINTTANEIFYCIFRRLDPEENHTAELVIPELPLALPPNERT

SEQ ID NO: 3 - protein, 245 aa, Homo Sapiens
MRIFAVFIFMTYWHLLNAFTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERTHHHHHH

SEQ ID NO: 4 - protein, 475 aa, Homo Sapiens
MRIFAVFIFMTYWHLLNAFTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERTIEGREPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5 - protein, 249 aa, Cynomologus
MGWSCIILFLVATATGVHSMFTVTVPKDLYVVEYGSNMTIECKFPVEKQLDLTSLIVYWEMEDKNIIQFVHGEEDLKVQHSNYRQRAQLLKDQLSLGNAALRITDVKLQDAGVYRCMISYGGADYKRITVKVNAPYNKINQRILVVDPVTSEHELTCQAEGYPKAEVIWTSSDHQVLSGKTTTTNSKREEKLLNVTSTLRINTTANEIFYCIFRRLDPEENHTAELVIPELPLALPPNERTDYKDDDDK

SEQ ID NO: 6 - protein, 405 aa, Homo Sapiens
MGWSCIILFLVATATGVHSLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQKLENLYFQGIEGRMDEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 7 - protein, 8 aa, Homo Sapiens
GFTFDDYA

SEQ ID NO: 8 - protein, 8 aa, Homo Sapiens
ISWKSNII

SEQ ID NO: 9 - protein, 15 aa, Homo Sapiens
ARDITGSGSYGWFDP

SEQ ID NO: 10 - protein, 5 aa, Homo Sapiens
DYAMH

SEQ ID NO: 11 - protein, 17 aa, Homo Sapiens
GISWKSNIIGYADSVKG

SEQ ID NO: 12 - protein, 13 aa, Homo Sapiens
DITGSGSYGWFDP

SEQ ID NO: 13 - protein, 122 aa, Homo Sapiens
EVQLVESGGGLVQPGRSLRLSCAASGFTFDDYAMHWVRQTPGKGLEWVSGISWKSNIIGYADSVKGRFTISRDNAKNSLYLQMNSLRAEDTALYYCARDITGSGSYGWFDPWGQGTLVTVSS

SEQ ID NO: 14 - DNA, 508 bp, Homo Sapiens
caagaaaaagcttgccgccaccatggagtttgggctgagctggattttccttttggctattttaaaaggtgtccagtgtgaagtacaattggtggagtccgggggaggcttggtacagcctggcaggtccctgagactctcctgtgcagcctctggattcacctttgatgattatgccatgcactgggtccgacaaactccagggaagggcctggagtgggtctcaggtataagttggaagagtaatatcataggctatgcggactctgtgaagggccgattcaccatctccagagacaacgccaagaactccctgtatctgcaaatgaacagtctgagagctgaggacacggccttgtattattgtgcaagagatataacgggttcggggagttatggctggttcgacccctggggccagggaaccctggtcaccgtctcctcagccaaaacgacacccccatctgtctatccactggcccctgaatctgctaaaactcagcctccg

SEQ ID NO: 15 - protein, 449 aa, Homo Sapiens
EVQLVESGGGLVQPGRSLRLSCAASGFTFDDYAMHWVRQTPGKGLEWVSGISWKSNIIGYADSVKGRFTISRDNAKNSLYLQMNSLRAEDTALYYCARDITGSGSYGWFDPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 16 - DNA, 1356 bp, Homo Sapiens
gaagtgcagctggtggaatctggcggcggactggtgcagcctggcagatccctgagactgtcttgtgccgcctccggcttcaccttcgacgactacgctatgcactgggtgcgacagacccctggcaagggcctggaatgggtgtccggcatctcctggaagtccaacatcatcggctacgccgactccgtgaagggccggttcaccatctcccgggacaacgccaagaactccctgtacctgcagatgaacagcctgcgggccgaggacaccgccctgtactactgcgccagagacatcaccggctccggctcctacggatggttcgatccttggggccagggcaccctcgtgaccgtgtcctctgccagcaccaagggcccctctgtgttccctctggccccttccagcaagtccacctctggcggaacagccgctctgggctgcctcgtgaaggactacttccccgagcctgtgaccgtgtcctggaactctggcgctctgaccagcggagtgcacaccttccctgctgtgctgcagtcctccggcctgtactccctgtcctccgtcgtgaccgtgccttccagctctctgggcacccagacctacatctgcaacgtgaaccacaagccctccaacaccaaggtggacaagaaggtggaacccaagtcctgcgacaagacccacacctgtcccccttgtcctgcccctgaactgctgggcggaccttccgtgttcctgttccccccaaagcccaaggacaccctgatgatctcccggacccccgaagtgacctgcgtggtggtggatgtgtcccacgaggaccctgaagtgaagttcaattggtacgtggacggcgtggaagtgcacaacgccaagaccaagcctagagaggaacagtacaactccacctaccgggtggtgtccgtgctgaccgtgctgcaccaggattggctgaacggcaaagagtacaagtgcaaggtgtccaacaaggccctgcctgcccccatcgaaaagaccatctccaaggccaagggccagccccgggaaccccaggtgtacacactgccccctagcagggacgagctgaccaagaaccaggtgtccctgacctgtctcgtgaaaggcttctacccctccgatatcgccgtggaatgggagtccaacggccagcctgagaacaactacaagaccaccccccctgtgctggactccgacggctcattcttcctgtacagcaagctgacagtggacaagtcccggtggcagcagggcaacgtgttctcctgctccgtgatgcacgaggccctgcacaaccactacacccagaagtccctgtccctgagccccggcaag

SEQ ID NO: 17 - protein, 6 aa, Homo Sapiens
QSISSY

SEQ ID NO: 18 - protein, 3 aa, Homo Sapiens
VAS

SEQ ID NO: 19 - protein, 9 aa, Homo Sapiens
QQSYSNPIT

SEQ ID NO: 20 - protein, 11 aa, Homo Sapiens
RASQSISSYLN

SEQ ID NO: 21 - protein, 7 aa, Homo Sapiens
VASSLQS

SEQ ID NO: 22 - protein, 9 aa, Homo Sapiens
QQSYSNPIT

SEQ ID NO: 23 - protein, 107 aa, Homo Sapiens
DIQMTQSPSSLSASVGDRVTITCRASQSISSYLNWYQQKPGKAPKPLIYVASSLQSGVPSSFSGSGSGTDFTLTISSLQPEDFATYYCQQSYSNPITFGQGTRLEIK

SEQ ID NO: 24 - DNA, 321 bp, Homo Sapiens
gacatccagatgacccagtctccatcctccctgtctgcatctgtaggagacagagtcaccatcacttgccgggcaagtcagagcattagcagctatttaaattggtatcagcagaaaccagggaaagcccctaagcccctgatctatgttgcatccagtttgcaaagtggggtcccatcaagtttcagtggcagtggatctgggacagatttcactctcaccatcagcagtctgcaacctgaagattttgcaacttactactgtcaacagagttacagtaatccgatcaccttcggccaagggacacgactggagatcaaa

SEQ ID NO: 25 - protein, 214 aa, Homo Sapiens
DIQMTQSPSSLSASVGDRVTITCRASQSISSYLNWYQQKPGKAPKPLIYVASSLQSGVPSSFSGSGSGTDFTLTISSLQPEDFATYYCQQSYSNPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 26 - DNA, 642 bp, Homo Sapiens
gacatccagatgacccagtctccatcctccctgtctgcatctgtaggagacagagtcaccatcacttgccgggcaagtcagagcattagcagctatttaaattggtatcagcagaaaccagggaaagcccctaagcccctgatctatgttgcatccagtttgcaaagtggggtcccatcaagtttcagtggcagtggatctgggacagatttcactctcaccatcagcagtctgcaacctgaagattttgcaacttactactgtcaacagagttacagtaatccgatcaccttcggccaagggacacgactggagatcaaacgtacggtggccgctccctccgtgttcatcttcccaccttccgacgagcagctgaagtccggcaccgcttctgtcgtgtgcctgctgaacaacttctacccccgcgaggccaaggtgcagtggaaggtggacaacgccctgcagtccggcaactcccaggaatccgtgaccgagcaggactccaaggacagcacctactccctgtcctccaccctgaccctgtccaaggccgactacgagaagcacaaggtgtacgcctgcgaagtgacccaccagggcctgtctagccccgtgaccaagtctttcaaccggggcgagtgt

SEQ ID NO: 27 - protein, 8 aa, Homo Sapiens
GFTFDDYA

SEQ ID NO: 28 - protein, 8 aa, Homo Sapiens
ISWIRTGI

SEQ ID NO: 29 - protein, 16 aa, Homo Sapiens
AKDMKGSGTYGGWFDT

SEQ ID NO: 30 - protein, 5 aa, Homo Sapiens
DYAMH

SEQ ID NO: 31 - protein, 17 aa, Homo Sapiens
GISWIRTGIGYADSVKG

SEQ ID NO: 32 - protein, 14 aa, Homo Sapiens
DMKGSGTYGGWFDT

SEQ ID NO: 33 - protein, 123 aa, Homo Sapiens
EVQLVESGGGLVQPGRSLRLSCAASGFTFDDYAMHWVRQVPGKGLEWVSGISWIRTGIGYADSVKGRFTIFRDNAKNSLYLQMNSLRAEDTALYYCAKDMKGSGTYGGWFDTWGQGTLVTVSS

SEQ ID NO: 34 - DNA, 482 bp, Homo Sapiens
aagcttgccgccaccatggagtttgggctgagctggattttccttttggctattttaaaaggtgtccagtgtgaagtgcagctggtggagtctgggggaggcttggtgcagcctggcaggtccctgagactctcctgtgcagcctctggattcacctttgatgattatgccatgcactgggtccggcaagttccagggaagggcctggaatgggtctcaggcattagttggattcgtactggcataggctatgcggactctgtgaagggccgattcaccattttcagagacaacgccaagaattccctgtatctgcaaatgaacagtctgagagctgaggacacggccttgtattactgtgcaaaagatatgaagggttcggggacttatggggggtggttcgacacctggggccagggaaccctggtcaccgtctcctcagccaaaacaacagccccatcggtctatccactggcccctgc

SEQ ID NO: 35 - protein, 450 aa, Homo Sapiens
EVQLVESGGGLVQPGRSLRLSCAASGFTFDDYAMHWVRQVPGKGLEWVSGISWIRTGIGYADSVKGRFTIFRDNAKNSLYLQMNSLRAEDTALYYCAKDMKGSGTYGGWFDTWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 36 - DNA, 1359 bp, Homo Sapiens
gaagtgcagctggtggaatctggcggcggactggtgcagcctggcagatccctgagactgtcttgtgccgcctccggcttcaccttcgacgactacgctatgcactgggtgcgacaggtgccaggcaagggcctggaatgggtgtccggcatctcttggatccggaccggcatcggctacgccgactctgtgaagggccggttcaccatcttccgggacaacgccaagaactccctgtacctgcagatgaacagcctgcgggccgaggacaccgccctgtactactgcgccaaggacatgaagggctccggcacctacggcggatggttcgatacttggggccagggcaccctcgtgaccgtgtcctctgccagcaccaagggcccctctgtgttccctctggccccttccagcaagtccacctctggcggaacagccgctctgggctgcctcgtgaaggactacttccccgagcctgtgaccgtgtcctggaactctggcgctctgaccagcggagtgcacaccttccctgctgtgctgcagtcctccggcctgtactccctgtcctccgtcgtgaccgtgccttccagctctctgggcacccagacctacatctgcaacgtgaaccacaagccctccaacaccaaggtggacaagaaggtggaacccaagtcctgcgacaagacccacacctgtcccccttgtcctgcccctgaactgctgggcggaccttccgtgttcctgttccccccaaagcccaaggacaccctgatgatctcccggacccccgaagtgacctgcgtggtggtggatgtgtcccacgaggaccctgaagtgaagttcaattggtacgtggacggcgtggaagtgcacaacgccaagaccaagcctagagaggaacagtacaactccacctaccgggtggtgtccgtgctgaccgtgctgcaccaggattggctgaacggcaaagagtacaagtgcaaggtgtccaacaaggccctgcctgcccccatcgaaaagaccatctccaaggccaagggccagccccgggaaccccaggtgtacacactgccccctagcagggacgagctgaccaagaaccaggtgtccctgacctgtctcgtgaaaggcttctacccctccgatatcgccgtggaatgggagtccaacggccagcctgagaacaactacaagaccaccccccctgtgctggactccgacggctcattcttcctgtacagcaagctgacagtggacaagtcccggtggcagcagggcaacgtgttctcctgctccgtgatgcacgaggccctgcacaaccactacacccagaagtccctgtccctgagccccggcaag

SEQ ID NO: 37 - protein, 6 aa, Homo Sapiens
QSISSY

SEQ ID NO: 38 - protein, 3 aa, Homo Sapiens
VAS

SEQ ID NO: 39 - protein, 9 aa, Homo Sapiens
QQSYSTPIT

SEQ ID NO: 40 - protein, 11 aa, Homo Sapiens
RASQSISSYLN

SEQ ID NO: 41 - protein, 7 aa, Homo Sapiens
VASSLQS

SEQ ID NO: 42 - protein, 9 aa, Homo Sapiens
QQSYSTPIT

SEQ ID NO: 43 - protein, 107 aa, Homo Sapiens
DIQMTQSPSSLSASVGDRVTITCRASQSISSYLNWYQQKPGKAPKLLIYVASSLQSGVPSRFSGSGSGTDFTLTISSLQPEDFATYYCQQSYSTPITFGQGTRLEIK

SEQ ID NO: 44 - DNA, 418 bp, Homo Sapiens
aaagcttgccgccaccatgaggctccctgctcagcttctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaaactcctgatctatgttgcatccagtttgcaaagtggggtcccatcaaggttcagtggcagtggatctgggacagatttcactctcactatcagcagtctgcaacctgaagattttgcaacttactactgtcaacagagttacagtaccccgatcaccttcggccaagggacacgtctggagatcaaacgtacggatgctgcaccaact

SEQ ID NO: 45 - protein, 214 aa, Homo Sapiens
DIQMTQSPSSLSASVGDRVTITCRASQSISSYLNWYQQKPGKAPKLLIYVASSLQSGVPSRFSGSGSGTDFTLTISSLQPEDFATYYCQQSYSTPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 46 - DNA, 642 bp, Homo Sapiens
gacatccagatgacccagtccccctccagcctgtctgcttccgtgggcgacagagtgaccatcacctgtcgggcctcccagtccatctcctcctacctgaactggtatcagcagaagcccggcaaggcccccaagctgctgatctacgtggccagctctctgcagtccggcgtgccctctagattctccggctctggctctggcaccgactttaccctgaccatcagctccctgcagcccgaggacttcgccacctactactgccagcagtcctactccacccctatcaccttcggccagggcacccggctggaaatcaaacgtacggtggccgctccctccgtgttcatcttcccaccttccgacgagcagctgaagtccggcaccgcttctgtcgtgtgcctgctgaacaacttctacccccgcgaggccaaggtgcagtggaaggtggacaacgccctgcagtccggcaactcccaggaatccgtgaccgagcaggactccaaggacagcacctactccctgtcctccaccctgaccctgtccaaggccgactacgagaagcacaaggtgtacgcctgcgaagtgacccaccagggcctgtctagccccgtgaccaagtctttcaaccggggcgagtgt

SEQ ID NO: 47 - protein, 450 aa, Homo Sapiens
EVQLVESGGGLVQPGRSLRLSCAASGFTFDDYAMHWVRQAPGKGLEWVSGISWIRTGIGYADSVKGRFTIFRDNAKNSLYLQMNSLRAEDTALYYCAKDMKGSGTYGGWFDTWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPELAGAPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 48 - protein, 450 aa, Homo Sapiens
EVQLVESGGGLVQPGRSLRLSCAASGFTFDDYAMHWVRQVPGKGLEWVSGISWIRTGIGYADSVKGRFTISRDNAKNSLYLQMNSLRAEDTALYYCAKDMKGSGTYGGWFDTWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPELAGAPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 49 - protein, 448 aa, Homo Sapiens
EVQLVESGGGLVQPGRSLRLSCAASGFTFDDYAMHWVRQVPGKGLEWVSGISWIRTGIGYADSVKGRFTIFRDNAKNSLYLQMNSLRAEDTALYYCAKDMKGSGTYGGWFDTWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 50 - protein, 214 aa, Homo Sapiens
DIQMTQSPSSLSASVGDRVTITCRASQSISSYLNWYQQKPGKAPKLLIYAASSLQSGVPSRFSGSGSGTDFTLTISSLQPEDFATYYCQQSYSTPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 51 - protein, 214 aa, Homo Sapiens
DIQMTQSPSSLSASVGDRVTITCRASQSISSYLNWYQQKPGKAPKLFIYVASSLQSGVPSRFSGSGSGTDFTLTISSLQPEDFATYYCQQSYSTPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 52 - protein, 8 aa, Homo Sapiens
GFTFSSYW

SEQ ID NO: 53 - protein, 8 aa, Homo Sapiens
IKEDGSEK

SEQ ID NO: 54 - protein, 12 aa, Homo Sapiens
ARNRLYSDFLDN

SEQ ID NO: 55 - protein, 5 aa, Homo Sapiens
SYWMS

SEQ ID NO: 56 - protein, 17 aa, Homo Sapiens
NIKEDGSEKYYVDSVKG

SEQ ID NO: 57 - protein, 10 aa, Homo Sapiens
NRLYSDFLDN

SEQ ID NO: 58 - protein, 119 aa, Homo Sapiens
EVQLVESGGGLVQPGGSLRLSCAASGFTFSSYWMSWVRQAPGKGLEWVANIKEDGSEKYYVDSVKGRFTISRDNAKNSLYLQMNSLRAEDTSVYYCARNRLYSDFLDNWGQGTLVTVSS

SEQ ID NO: 59 - DNA, 358 bp, Homo Sapiens
gaggtgcagctggtggagtctgggggaggcttggtccagcctggggggtccctgagactctcctgtgcagcctctggattcacgtttagtagctattggatgagttgggtccgccaggctccagggaaggggctggagtgggtggccaacatcaaagaagatggaagtgagaaatactatgtcgactctgtgaagggccgattcaccatctccagagacaacgccaagaactcactgtatctgcaaatgaacagcctgagagccgaggacacgtctgtgtattactgtgcgagaaatcgactctacagtgacttccttgacaactggggccagggaaccctggtcaccgtctcctcag

SEQ ID NO: 60 - protein, 449 aa, Homo Sapiens
EVQLVESGGGLVQPGGSLRLSCAASGFTFSSYWMSWVRQAPGKGLEWVANIKEDGSEKYYVDSVKGRFTISRDNAKNSLYLQMNSLRAEDTSVYYCARNRLYSDFLDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 61 - DNA, 1347 bp, Homo Sapiens
gaggtgcagctggtggagtctgggggaggcttggtccagcctggggggtccctgagactctcctgtgcagcctctggattcacgtttagtagctattggatgagttgggtccgccaggctccagggaaggggctggagtgggtggccaacatcaaagaagatggaagtgagaaatactatgtcgactctgtgaagggccgattcaccatctccagagacaacgccaagaactcactgtatctgcaaatgaacagcctgagagccgaggacacgtctgtgtattactgtgcgagaaatcgactctacagtgacttccttgacaactggggccagggaaccctggtcaccgtctcctcagccagcaccaagggcccctctgtgttccctctggccccttccagcaagtccacctctggcggaacagccgctctgggctgcctcgtgaaggactacttccccgagcctgtgaccgtgtcctggaactctggcgctctgaccagcggagtgcacaccttccctgctgtgctgcagtcctccggcctgtactccctgtcctccgtcgtgaccgtgccttccagctctctgggcacccagacctacatctgcaacgtgaaccacaagccctccaacaccaaggtggacaagaaggtggaacccaagtcctgcgacaagacccacacctgtcccccttgtcctgcccctgaactgctgggcggaccttccgtgttcctgttccccccaaagcccaaggacaccctgatgatctcccggacccccgaagtgacctgcgtggtggtggatgtgtcccacgaggaccctgaagtgaagttcaattggtacgtggacggcgtggaagtgcacaacgccaagaccaagcctagagaggaacagtacaactccacctaccgggtggtgtccgtgctgaccgtgctgcaccaggattggctgaacggcaaagagtacaagtgcaaggtgtccaacaaggccctgcctgcccccatcgaaaagaccatctccaaggccaagggccagccccgggaaccccaggtgtacacactgccccctagcagggacgagctgaccaagaaccaggtgtccctgacctgtctcgtgaaaggcttctacccctccgatatcgccgtggaatgggagtccaacggccagcctgagaacaactacaagaccaccccccctgtgctggactccgacggctcattcttcctgtacagcaagctgacagtggacaagtcccggtggcagcagggcaacgtgttctcctgctccgtgatgcacgaggccctgcacaaccactacacccagaagtccctgtccctgagccccggcaag

SEQ ID NO: 62 - protein, 6 aa, Homo Sapiens
QGVSSW

SEQ ID NO: 63 - protein, 3 aa, Homo Sapiens
GAS

SEQ ID NO: 64 - protein, 9 aa, Homo Sapiens
QQANSIPFT

SEQ ID NO: 65 - protein, 11 aa, Homo Sapiens
RASQGVSSWLA

SEQ ID NO: 66 - protein, 7 aa, Homo Sapiens
GASSLQS

SEQ ID NO: 67 - protein, 9 aa, Homo Sapiens
QQANSIPFT

SEQ ID NO: 68 - protein, 107 aa, Homo Sapiens
DIQMTQSPSSVSASVGDRVTITCRASQGVSSWLAWYQQKSGKAPKLLIYGASSLQSGVPSRFSGSGSGTEFILTISSLQPEDFATYYCQQANSIPFTFGPGTKVDIK

SEQ ID NO: 69 - DNA, 322 bp, Homo Sapiens
gacatccagatgacccagtctccatcttccgtgtctgcatctgtcggagacagagtcaccatcacttgtcgggcgagtcagggtgttagcagctggttagcctggtatcagcagaaatcagggaaagcccctaagctcctgatctatggtgcatccagtttgcaaagtggggtcccatcaagattcagcggcagtggatctgggacagagttcattctcaccatcagcagcctgcagcctgaagattttgcaacttactattgtcaacaggctaacagtatcccattcactttcggccctgggaccaaagtggatatcaaac

SEQ ID NO: 70 - protein, 214 aa, Homo Sapiens
DIQMTQSPSSVSASVGDRVTITCRASQGVSSWLAWYQQKSGKAPKLLIYGASSLQSGVPSRFSGSGSGTEFILTISSLQPEDFATYYCQQANSIPFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 71 - DNA, 642 bp, Homo Sapiens
gacatccagatgacccagtctccatcttccgtgtctgcatctgtcggagacagagtcaccatcacttgtcgggcgagtcagggtgttagcagctggttagcctggtatcagcagaaatcagggaaagcccctaagctcctgatctatggtgcatccagtttgcaaagtggggtcccatcaagattcagcggcagtggatctgggacagagttcattctcaccatcagcagcctgcagcctgaagattttgcaacttactattgtcaacaggctaacagtatcccattcactttcggccctgggaccaaagtggatatcaaacgtacggtggccgctccctccgtgttcatcttcccaccttccgacgagcagctgaagtccggcaccgcttctgtcgtgtgcctgctgaacaacttctacccccgcgaggccaaggtgcagtggaaggtggacaacgccctgcagtccggcaactcccaggaatccgtgaccgagcaggactccaaggacagcacctactccctgtcctccaccctgaccctgtccaaggccgactacgagaagcacaaggtgtacgcctgcgaagtgacccaccagggcctgtctagccccgtgaccaagtctttcaaccggggcgagtgt

SEQ ID NO: 72 - protein, 8 aa, Homo Sapiens
GFTFSSYW

SEQ ID NO: 73 - protein, 8 aa, Homo Sapiens
IKEDGSEK

SEQ ID NO: 74 - protein, 12 aa, Homo Sapiens
ARVRLYSDFLDY

SEQ ID NO: 75 - protein, 5 aa, Homo Sapiens
SYWMS

SEQ ID NO: 76 - protein, 17 aa, Homo Sapiens
NIKEDGSEKYYVDSLKG

SEQ ID NO: 77 - protein, 10 aa, Homo Sapiens
VRLYSDFLDY

SEQ ID NO: 78 - protein, 119 aa, Homo Sapiens
EVQLVDSGGGLVQPGGSLRLSCAASGFTFSSYWMSWVRQAPGKGLEWVANIKEDGSEKYYVDSLKGRFTISRDNAKNSLYLQMNSLRAEDTSVYYCARVRLYSDFLDYWGQGTLVTVSS

SEQ ID NO: 79 - DNA, 358 bp, Homo Sapiens
gaggtgcagctggtggactctgggggaggcttggtccagcctggggggtccctgagactctcctgtgcagcctctggattcacgtttagtagctattggatgagttgggtccgccaggctccaggaaaggggctggagtgggtggccaacataaaagaagatggaagtgagaaatactatgtagactctttgaagggccgattcaccatctccagagacaacgccaagaactcactgtatctgcaaatgaacagcctgagagccgaggacacgtctgtgtattactgtgcgagagttcgactctacagtgacttccttgactactggggccagggaaccctggtcaccgtctcctcag

SEQ ID NO: 80 - protein, 449 aa, Homo Sapiens
EVQLVDSGGGLVQPGGSLRLSCAASGFTFSSYWMSWVRQAPGKGLEWVANIKEDGSEKYYVDSLKGRFTISRDNAKNSLYLQMNSLRAEDTSVYYCARVRLYSDFLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 81 - DNA, 1347 bp, Homo Sapiens
gaggtgcagctggtggactctgggggaggcttggtccagcctggggggtccctgagactctcctgtgcagcctctggattcacgtttagtagctattggatgagttgggtccgccaggctccaggaaaggggctggagtgggtggccaacataaaagaagatggaagtgagaaatactatgtagactctttgaagggccgattcaccatctccagagacaacgccaagaactcactgtatctgcaaatgaacagcctgagagccgaggacacgtctgtgtattactgtgcgagagttcgactctacagtgacttccttgactactggggccagggaaccctggtcaccgtctcctcagccagcaccaagggcccctctgtgttccctctggccccttccagcaagtccacctctggcggaacagccgctctgggctgcctcgtgaaggactacttccccgagcctgtgaccgtgtcctggaactctggcgctctgaccagcggagtgcacaccttccctgctgtgctgcagtcctccggcctgtactccctgtcctccgtcgtgaccgtgccttccagctctctgggcacccagacctacatctgcaacgtgaaccacaagccctccaacaccaaggtggacaagaaggtggaacccaagtcctgcgacaagacccacacctgtcccccttgtcctgcccctgaactgctgggcggaccttccgtgttcctgttccccccaaagcccaaggacaccctgatgatctcccggacccccgaagtgacctgcgtggtggtggatgtgtcccacgaggaccctgaagtgaagttcaattggtacgtggacggcgtggaagtgcacaacgccaagaccaagcctagagaggaacagtacaactccacctaccgggtggtgtccgtgctgaccgtgctgcaccaggattggctgaacggcaaagagtacaagtgcaaggtgtccaacaaggccctgcctgcccccatcgaaaagaccatctccaaggccaagggccagccccgggaaccccaggtgtacacactgccccctagcagggacgagctgaccaagaaccaggtgtccctgacctgtctcgtgaaaggcttctacccctccgatatcgccgtggaatgggagtccaacggccagcctgagaacaactacaagaccaccccccctgtgctggactccgacggctcattcttcctgtacagcaagctgacagtggacaagtcccggtggcagcagggcaacgtgttctcctgctccgtgatgcacgaggccctgcacaaccactacacccagaagtccctgtccctgagccccggcaag

SEQ ID NO: 82 - protein, 6 aa, Homo Sapiens
QGVSSW

SEQ ID NO: 83 - protein, 3 aa, Homo Sapiens
GAS

SEQ ID NO: 84 - protein, 9 aa, Homo Sapiens
QQANSIPFT

SEQ ID NO: 85 - protein, 11 aa, Homo Sapiens
RASQGVSSWLA

SEQ ID NO: 86 - protein, 7 aa, Homo Sapiens
GASSLQS

SEQ ID NO: 87 - protein, 9 aa, Homo Sapiens
QQANSIPFT

SEQ ID NO: 88 - protein, 107 aa, Homo Sapiens
DIQMTQSPSSVSASVGDRVTITCRASQGVSSWLAWYQQKSGKAPKLLIYGASSLQSGVPSRFSGSGSGTEFILSISSLQPEDFATYYCQQANSIPFTFGPGTKVDIK

SEQ ID NO: 89 - DNA, 322 bp, Homo Sapiens
gacatccagatgacccagtctccatcttccgtgtctgcatctgtcggagacagagtcaccatcacttgtcgggcgagtcagggtgttagcagttggttagcctggtatcagcagaaatcagggaaagcccctaagctcctgatctatggtgcctccagtttgcaaagtggggtcccatcaagattcagcggcagtggatctgggacagagttcattctcagcatcagcagcctgcagcctgaagattttgcaacttactattgtcaacaggctaacagtatcccattcactttcggccctgggaccaaagtggatatcaaac

SEQ ID NO: 90 - protein, 214 aa, Homo Sapiens
DIQMTQSPSSVSASVGDRVTITCRASQGVSSWLAWYQQKSGKAPKLLIYGASSLQSGVPSRFSGSGSGTEFILSISSLQPEDFATYYCQQANSIPFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 91 - DNA, 642 bp, Homo Sapiens
gacatccagatgacccagtctccatcttccgtgtctgcatctgtcggagacagagtcaccatcacttgtcgggcgagtcagggtgttagcagttggttagcctggtatcagcagaaatcagggaaagcccctaagctcctgatctatggtgcctccagtttgcaaagtggggtcccatcaagattcagcggcagtggatctgggacagagttcattctcagcatcagcagcctgcagcctgaagattttgcaacttactattgtcaacaggctaacagtatcccattcactttcggccctgggaccaaagtggatatcaaacgtacggtggccgctccctccgtgttcatcttcccaccttccgacgagcagctgaagtccggcaccgcttctgtcgtgtgcctgctgaacaacttctacccccgcgaggccaaggtgcagtggaaggtggacaacgccctgcagtccggcaactcccaggaatccgtgaccgagcaggactccaaggacagcacctactccctgtcctccaccctgaccctgtccaaggccgactacgagaagcacaaggtgtacgcctgcgaagtgacccaccagggcctgtctagccccgtgaccaagtctttcaaccggggcgagtgt

SEQ ID NO: 92 - protein, 9 aa, Homo Sapiens
GGSIISSDW

SEQ ID NO: 93 - protein, 7 aa, Homo Sapiens
IFHSGRT

SEQ ID NO: 94 - protein, 8 aa, Homo Sapiens
ARDGSGSY

SEQ ID NO: 95 - protein, 6 aa, Homo Sapiens
SSDWWN

SEQ ID NO: 96 - protein, 16 aa, Homo Sapiens
EIFHSGRTNYNPSLKS

SEQ ID NO: 97 - protein, 6 aa, Homo Sapiens
DGSGSY

SEQ ID NO: 98 - protein, 115 aa, Homo Sapiens
QVQLQESGPGLVKPSGTLSLTCIVSGGSIISSDWWNWVRQPPGKGLEWIGEIFHSGRTNYNPSLKSRVTISIDKSKNQFSLRLSSVTAADTAVYYCARDGSGSYWGQGTLVTVSS

SEQ ID NO: 99 - DNA, 346 bp, Homo Sapiens
caggtgcagctgcaggagtcgggcccaggactggtgaagccttcggggaccctgtccctcacctgcattgtctctggtggctccatcatcagtagtgactggtggaattgggtccgccagcccccagggaaggggctggagtggattggagaaatctttcatagtgggaggaccaactacaacccgtccctcaagagtcgagtcaccatatcaatagacaagtccaagaatcagttctccctgaggctgagctctgtgaccgccgcggacacggccgtgtattactgtgcgagagatggttcggggagttactggggccagggaaccctggtcaccgtctcctcag

SEQ ID NO: 100 - protein, 445 aa, Homo Sapiens
QVQLQESGPGLVKPSGTLSLTCIVSGGSIISSDWWNWVRQPPGKGLEWIGEIFHSGRTNYNPSLKSRVTISIDKSKNQFSLRLSSVTAADTAVYYCARDGSGSYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 101 - DNA, 1335 bp, Homo Sapiens
caggtgcagctgcaggagtcgggcccaggactggtgaagccttcggggaccctgtccctcacctgcattgtctctggtggctccatcatcagtagtgactggtggaattgggtccgccagcccccagggaaggggctggagtggattggagaaatctttcatagtgggaggaccaactacaacccgtccctcaagagtcgagtcaccatatcaatagacaagtccaagaatcagttctccctgaggctgagctctgtgaccgccgcggacacggccgtgtattactgtgcgagagatggttcggggagttactggggccagggaaccctggtcaccgtctcctcagccagcaccaagggcccctctgtgttccctctggccccttccagcaagtccacctctggcggaacagccgctctgggctgcctcgtgaaggactacttccccgagcctgtgaccgtgtcctggaactctggcgctctgaccagcggagtgcacaccttccctgctgtgctgcagtcctccggcctgtactccctgtcctccgtcgtgaccgtgccttccagctctctgggcacccagacctacatctgcaacgtgaaccacaagccctccaacaccaaggtggacaagaaggtggaacccaagtcctgcgacaagacccacacctgtcccccttgtcctgcccctgaactgctgggcggaccttccgtgttcctgttccccccaaagcccaaggacaccctgatgatctcccggacccccgaagtgacctgcgtggtggtggatgtgtcccacgaggaccctgaagtgaagttcaattggtacgtggacggcgtggaagtgcacaacgccaagaccaagcctagagaggaacagtacaactccacctaccgggtggtgtccgtgctgaccgtgctgcaccaggattggctgaacggcaaagagtacaagtgcaaggtgtccaacaaggccctgcctgcccccatcgaaaagaccatctccaaggccaagggccagccccgggaaccccaggtgtacacactgccccctagcagggacgagctgaccaagaaccaggtgtccctgacctgtctcgtgaaaggcttctacccctccgatatcgccgtggaatgggagtccaacggccagcctgagaacaactacaagaccaccccccctgtgctggactccgacggctcattcttcctgtacagcaagctgacagtggacaagtcccggtggcagcagggcaacgtgttctcctgctccgtgatgcacgaggccctgcacaaccactacacccagaagtccctgtccctgagccccggcaag

SEQ ID NO: 102 - protein, 12 aa, Homo Sapiens
QSVLYSSNNKNY

SEQ ID NO: 103 - protein, 3 aa, Homo Sapiens
WAS

SEQ ID NO: 104 - protein, 8 aa, Homo Sapiens
QQYYSNRS

SEQ ID NO: 105 - protein, 17 aa, Homo Sapiens
KSSQSVLYSSNNKNYLA

SEQ ID NO: 106 - protein, 7 aa, Homo Sapiens
WASTRES

SEQ ID NO: 107 - protein, 8 aa, Homo Sapiens
QQYYSNRS

SEQ ID NO: 108 - protein, 112 aa, Homo Sapiens
DIVMTQSPDSLAVSLGERATINCKSSQSVLYSSNNKNYLAWYQQKSGQPPKLLIYWASTRESGVPDRFSGSGSGTDFTLTISSLQTEDVAVYYCQQYYSNRSFGQGTKLEIK

SEQ ID NO: 109 - DNA, 337 bp, Homo Sapiens
gacatcgtgatgacccagtctccagactccctggctgtgtctctgggcgagagggccaccatcaactgcaagtccagccagagtgttttatacagctccaacaataagaattacttagcttggtaccagcagaaatcaggacagcctcctaagttgctcatttactgggcatctacccgggaatccggggtccctgaccgattcagtggcagcgggtctgggacagatttcactctcaccatcagcagcctgcagactgaagatgtggcagtttattactgtcagcaatattatagtaatcgcagttttggccaggggaccaagctggagatcaaac

SEQ ID NO: 110 - protein, 219 aa, Homo Sapiens
DIVMTQSPDSLAVSLGERATINCKSSQSVLYSSNNKNYLAWYQQKSGQPPKLLIYWASTRESGVPDRFSGSGSGTDFTLTISSLQTEDVAVYYCQQYYSNRSFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 111 - DNA, 657 bp, Homo Sapiens
gacatcgtgatgacccagtctccagactccctggctgtgtctctgggcgagagggccaccatcaactgcaagtccagccagagtgttttatacagctccaacaataagaattacttagcttggtaccagcagaaatcaggacagcctcctaagttgctcatttactgggcatctacccgggaatccggggtccctgaccgattcagtggcagcgggtctgggacagatttcactctcaccatcagcagcctgcagactgaagatgtggcagtttattactgtcagcaatattatagtaatcgcagttttggccaggggaccaagctggagatcaaacgtacggtggccgctccctccgtgttcatcttcccaccttccgacgagcagctgaagtccggcaccgcttctgtcgtgtgcctgctgaacaacttctacccccgcgaggccaaggtgcagtggaaggtggacaacgccctgcagtccggcaactcccaggaatccgtgaccgagcaggactccaaggacagcacctactccctgtcctccaccctgaccctgtccaaggccgactacgagaagcacaaggtgtacgcctgcgaagtgacccaccagggcctgtctagccccgtgaccaagtctttcaaccggggcgagtgt

SEQ ID NO: 112 - protein, 8 aa, Homo Sapiens
GFTFSSYW

SEQ ID NO: 113 - protein, 8 aa, Homo Sapiens
IKEDGSEK

SEQ ID NO: 114 - protein, 12 aa, Homo Sapiens
ARNRLYSDFLDN

SEQ ID NO: 115 - protein, 5 aa, Homo Sapiens
SYWMS

SEQ ID NO: 116 - protein, 17 aa, Homo Sapiens
NIKEDGSEKYYVDSVKG

SEQ ID NO: 117 - protein, 10 aa, Homo Sapiens
NRLYSDFLDN

SEQ ID NO: 118 - protein, 119 aa, Homo Sapiens; identical to SEQ ID NO: 58

SEQ ID NO: 119 - DNA, 358 bp, Homo Sapiens; identical to SEQ ID NO: 59

SEQ ID NO: 120 - protein, 449 aa, Homo Sapiens; identical to SEQ ID NO: 60

SEQ ID NO: 121 - DNA, 1347 bp, Homo Sapiens; identical to SEQ ID NO: 61

SEQ ID NO: 122 - protein, 6 aa, Homo Sapiens
QGVSSW

SEQ ID NO: 123 - protein, 3 aa, Homo Sapiens
GAS

SEQ ID NO: 124 - protein, 9 aa, Homo Sapiens
QQANSIPFT

SEQ ID NO: 125 - protein, 11 aa, Homo Sapiens
RASQGVSSWLA

SEQ ID NO: 126 - protein, 7 aa, Homo Sapiens
GASSLQS

SEQ ID NO: 127 - protein, 9 aa, Homo Sapiens
QQANSIPFT

SEQ ID NO: 128 - protein, 107 aa, Homo Sapiens; identical to SEQ ID NO: 68

SEQ ID NO: 129 - DNA, 322 bp, Homo Sapiens; identical to SEQ ID NO: 69

SEQ ID NO: 130 - protein, 214 aa, Homo Sapiens; identical to SEQ ID NO: 70

SEQ ID NO: 131 - DNA, 642 bp, Homo Sapiens; identical to SEQ ID NO: 71

SEQ ID NO: 132 - protein, 8 aa, Homo Sapiens
GFTFRIYG

SEQ ID NO: 133 - protein, 8 aa, Homo Sapiens
IWYDGSNK

SEQ ID NO: 134 - protein, 11 aa, Homo Sapiens
ARDMDYFGMDV

SEQ ID NO: 135 - protein, 5 aa, Homo Sapiens
IYGMH

SEQ ID NO: 136 - protein, 17 aa, Homo Sapiens
VIWYDGSNKYYADSVKG

SEQ ID NO: 137 - protein, 9 aa, Homo Sapiens
DMDYFGMDV

SEQ ID NO: 138 - protein, 118 aa, Homo Sapiens
QVQLVESGGGVVQPGRSLRLSCAASGFTFRIYGMHWVRQAPGKGLEWVAVIWYDGSNKYYADSVKGRFTISRDNSDNTLYLQMNSLRAEDTAVYYCARDMDYFGMDVWGQGTTVTVSS

SEQ ID NO: 139 - DNA, 355 bp, Homo Sapiens
caggtgcagctggtggagtctgggggaggcgtggtccagcctgggaggtccctgagactctcctgtgcagcgtctggattcaccttccgtatttatggcatgcactgggtccgccaggctccaggcaaggggctggagtgggtggcagttatatggtatgatggaagtaataaatactatgctgactccgtgaagggccgattcaccatctccagagacaattccgacaacacgctgtatctgcaaatgaacagcctgagagccgaggacacggctgtgtattactgtgcgagagatatggactacttcggtatggacgtctggggccaagggaccacggtcaccgtctcctcag

SEQ ID NO: 140 - protein, 448 aa, Homo Sapiens
QVQLVESGGGVVQPGRSLRLSCAASGFTFRIYGMHWVRQAPGKGLEWVAVIWYDGSNKYYADSVKGRFTISRDNSDNTLYLQMNSLRAEDTAVYYCARDMDYFGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 141 - DNA, 1344 bp, Homo Sapiens
caggtgcagctggtggagtctgggggaggcgtggtccagcctgggaggtccctgagactctcctgtgcagcgtctggattcaccttccgtatttatggcatgcactgggtccgccaggctccaggcaaggggctggagtgggtggcagttatatggtatgatggaagtaataaatactatgctgactccgtgaagggccgattcaccatctccagagacaattccgacaacacgctgtatctgcaaatgaacagcctgagagccgaggacacggctgtgtattactgtgcgagagatatggactacttcggtatggacgtctggggccaagggaccacggtcaccgtctcctcagccagcaccaagggcccctctgtgttccctctggccccttccagcaagtccacctctggcggaacagccgctctgggctgcctcgtgaaggactacttccccgagcctgtgaccgtgtcctggaactctggcgctctgaccagcggagtgcacaccttccctgctgtgctgcagtcctccggcctgtactccctgtcctccgtcgtgaccgtgccttccagctctctgggcacccagacctacatctgcaacgtgaaccacaagccctccaacaccaaggtggacaagaaggtggaacccaagtcctgcgacaagacccacacctgtcccccttgtcctgcccctgaactgctgggcggaccttccgtgttcctgttccccccaaagcccaaggacaccctgatgatctcccggacccccgaagtgacctgcgtggtggtggatgtgtcccacgaggaccctgaagtgaagttcaattggtacgtggacggcgtggaagtgcacaacgccaagaccaagcctagagaggaacagtacaactccacctaccgggtggtgtccgtgctgaccgtgctgcaccaggattggctgaacggcaaagagtacaagtgcaaggtgtccaacaaggccctgcctgcccccatcgaaaagaccatctccaaggccaagggccagccccgggaaccccaggtgtacacactgccccctagcagggacgagctgaccaagaaccaggtgtccctgacctgtctcgtgaaaggcttctacccctccgatatcgccgtggaatgggagtccaacggccagcctgagaacaactacaagaccaccccccctgtgctggactccgacggctcattcttcctgtacagcaagctgacagtggacaagtcccggtggcagcagggcaacgtgttctcctgctccgtgatgcacgaggccctgcacaaccactacacccagaagtccctgtccctgagccccggcaag

SEQ ID NO: 142 - protein, 6 aa, Homo Sapiens
QGIRND

SEQ ID NO: 143 - protein, 3 aa, Homo Sapiens
AAS

SEQ ID NO: 144 - protein, 9 aa, Homo Sapiens
LQHNSYPRT

SEQ ID NO: 145 - protein, 11 aa, Homo Sapiens
RASQGIRNDLG

SEQ ID NO: 146 - protein, 7 aa, Homo Sapiens
AASSLQS

SEQ ID NO: 147 - protein, 9 aa, Homo Sapiens
LQHNSYPRT

SEQ ID NO: 148 - protein, 107 aa, Homo Sapiens
DLQMTQSPSSLSASVGDRVTITCRASQGIRNDLGWYQQKPGKAPKRLIYAASSLQSGVPSRFSGSGSGTEFTLTISSLQPEDFATYYCLQHNSYPRTFGQGTKVEIK

SEQ ID NO: 149 - DNA, 322 bp, Homo Sapiens
gacctccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtttgcaaagtggggtcccatcaaggttcagcggcagtggatctgggacagaattcactctcacaatcagcagcctgcagcctgaagattttgcaacttattactgtctacagcataatagttaccctcggacgttcggccaagggaccaaggtggaaatcaaac

SEQ ID NO: 150 - protein, 214 aa, Homo Sapiens
DLQMTQSPSSLSASVGDRVTITCRASQGIRNDLGWYQQKPGKAPKRLIYAASSLQSGVPSRFSGSGSGTEFTLTISSLQPEDFATYYCLQHNSYPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 151 - DNA, 642 bp, Homo Sapiens
gacctccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtttgcaaagtggggtcccatcaaggttcagcggcagtggatctgggacagaattcactctcacaatcagcagcctgcagcctgaagattttgcaacttattactgtctacagcataatagttaccctcggacgttcggccaagggaccaaggtggaaatcaaacgtacggtggccgctccctccgtgttcatcttcccaccttccgacgagcagctgaagtccggcaccgcttctgtcgtgtgcctgctgaacaacttctacccccgcgaggccaaggtgcagtggaaggtggacaacgccctgcagtccggcaactcccaggaatccgtgaccgagcaggactccaaggacagcacctactccctgtcctccaccctgaccctgtccaaggccgactacgagaagcacaaggtgtacgcctgcgaagtgacccaccagggcctgtctagccccgtgaccaagtctttcaaccggggcgagtgt

SEQ ID NO: 152 - protein, 9 aa, Homo Sapiens
GGSISSSDW

SEQ ID NO: 153 - protein, 7 aa, Homo Sapiens
IFHSGNT

SEQ ID NO: 154 - protein, 8 aa, Homo Sapiens
VRDGSGSY

SEQ ID NO: 155 - protein, 6 aa, Homo Sapiens
SSDWWS

SEQ ID NO: 156 - protein, 16 aa, Homo Sapiens
EIFHSGNTNYNPSLKS

SEQ ID NO: 157 - protein, 6 aa, Homo Sapiens
DGSGSY

SEQ ID NO: 158 - protein, 115 aa, Homo Sapiens
QVQLQESGPGLVKPSGTLSLTCAVSGGSISSSDWWSWVRQPPGKGLEWIGEIFHSGNTNYNPSLKSRVTISVDKSKNQISLRLNSVTAADTAVYYCVRDGSGSYWGQGTLVTVSS

SEQ ID NO: 159 - DNA, 346 bp, Homo Sapiens
caggtgcagctgcaggagtcgggcccaggactggtgaagccttcggggaccctgtccctcacctgcgctgtctctggtggctccatcagcagtagtgactggtggagttgggtccgccagcccccagggaaggggctggagtggattggggaaatctttcatagtgggaacaccaactacaacccgtccctcaagagtcgagtcaccatatcagtagacaagtccaagaaccagatctccctgaggctgaactctgtgaccgccgcggacacggccgtgtattactgtgtgagagatggttcggggagttactggggccagggaaccctggtcaccgtctcctcag

SEQ ID NO: 160 - protein, 445 aa, Homo Sapiens
QVQLQESGPGLVKPSGTLSLTCAVSGGSISSSDWWSWVRQPPGKGLEWIGEIFHSGNTNYNPSLKSRVTISVDKSKNQISLRLNSVTAADTAVYYCVRDGSGSYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 161 - DNA, 1335 bp, Homo Sapiens
caggtgcagctgcaggagtcgggcccaggactggtgaagccttcggggaccctgtccctcacctgcgctgtctctggtggctccatcagcagtagtgactggtggagttgggtccgccagcccccagggaaggggctggagtggattggggaaatctttcatagtgggaacaccaactacaacccgtccctcaagagtcgagtcaccatatcagtagacaagtccaagaaccagatctccctgaggctgaactctgtgaccgccgcggacacggccgtgtattactgtgtgagagatggttcggggagttactggggccagggaaccctggtcaccgtctcctcagccagcaccaagggcccctctgtgttccctctggccccttccagcaagtccacctctggcggaacagccgctctgggctgcctcgtgaaggactacttccccgagcctgtgaccgtgtcctggaactctggcgctctgaccagcggagtgcacaccttccctgctgtgctgcagtcctccggcctgtactccctgtcctccgtcgtgaccgtgccttccagctctctgggcacccagacctacatctgcaacgtgaaccacaagccctccaacaccaaggtggacaagaaggtggaacccaagtcctgcgacaagacccacacctgtcccccttgtcctgcccctgaactgctgggcggaccttccgtgttcctgttccccccaaagcccaaggacaccctgatgatctcccggacccccgaagtgacctgcgtggtggtggatgtgtcccacgaggaccctgaagtgaagttcaattggtacgtggacggcgtggaagtgcacaacgccaagaccaagcctagagaggaacagtacaactccacctaccgggtggtgtccgtgctgaccgtgctgcaccaggattggctgaacggcaaagagtacaagtgcaaggtgtccaacaaggccctgcctgcccccatcgaaaagaccatctccaaggccaagggccagccccgggaaccccaggtgtacacactgccccctagcagggacgagctgaccaagaaccaggtgtccctgacctgtctcgtgaaaggcttctacccctccgatatcgccgtggaatgggagtccaacggccagcctgagaacaactacaagaccaccccccctgtgctggactccgacggctcattcttcctgtacagcaagctgacagtggacaagtcccggtggcagcagggcaacgtgttctcctgctccgtgatgcacgaggccctgcacaaccactacacccagaagtccctgtccctgagccccggcaag

SEQ ID NO: 162 - protein, 12 aa, Homo Sapiens
QSVLYSSNNKNY

SEQ ID NO: 163 - protein, 3 aa, Homo Sapiens
WAS

SEQ ID NO: 164 - protein, 8 aa, Homo Sapiens
QQYYSTRS

SEQ ID NO: 165 - protein, 17 aa, Homo Sapiens
KSSQSVLYSSNNKNYLA

SEQ ID NO: 166 - protein, 7 aa, Homo Sapiens
WASTRES

SEQ ID NO: 167 - protein, 8 aa, Homo Sapiens
QQYYSTRS

SEQ ID NO: 168 - protein, 112 aa, Homo Sapiens
DIVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTRSFGQGTKLEIK

SEQ ID NO: 169 - DNA, 337 bp, Homo Sapiens
gacatcgtgatgacccagtctccagactccctggctgtgtctctgggcgagagggccaccatcaactgcaagtccagccagagtgttttatacagctccaacaataagaactacttagcttggtaccagcagaaaccaggacagcctcctaaactgctcatttactgggcatctacccgggaatccggggtccctgaccgattcagtggcagcgggtctgggacagatttcactctcaccatcagcagcctgcaggctgaagatgtggcagtttattactgtcagcaatattatagtactcgcagttttggccaggggaccaagctggagatcaaac

SEQ ID NO: 170 - protein, 219 aa, Homo Sapiens
DIVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTRSFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 171 - DNA, 657 bp, Homo Sapiens
gacatcgtgatgacccagtctccagactccctggctgtgtctctgggcgagagggccaccatcaactgcaagtccagccagagtgttttatacagctccaacaataagaactacttagcttggtaccagcagaaaccaggacagcctcctaaactgctcatttactgggcatctacccgggaatccggggtccctgaccgattcagtggcagcgggtctgggacagatttcactctcaccatcagcagcctgcaggctgaagatgtggcagtttattactgtcagcaatattatagtactcgcagttttggccaggggaccaagctggagatcaaacgtacggtggccgctccctccgtgttcatcttcccaccttccgacgagcagctgaagtccggcaccgcttctgtcgtgtgcctgctgaacaacttctacccccgcgaggccaaggtgcagtggaaggtggacaacgccctgcagtccggcaactcccaggaatccgtgaccgagcaggactccaaggacagcacctactccctgtcctccaccctgaccctgtccaaggccgactacgagaagcacaaggtgtacgcctgcgaagtgacccaccagggcctgtctagccccgtgaccaagtctttcaaccggggcgagtgt

SEQ ID NO: 172 - protein, 10 aa, Homo Sapiens
GGSISSSSYY

SEQ ID NO: 173 - protein, 7 aa, Homo Sapiens
IYSTGYT

SEQ ID NO: 174 - protein, 13 aa, Homo Sapiens
AISTAAGPEYFHR

SEQ ID NO: 175 - protein, 7 aa, Homo Sapiens
SSSYYCG

SEQ ID NO: 176 - protein, 16 aa, Homo Sapiens
SIYSTGYTYYNPSLKS

SEQ ID NO: 177 - protein, 11 aa, Homo Sapiens
STAAGPEYFHR

SEQ ID NO: 178 - protein, 120 aa, Homo Sapiens
QLQESGPGLVKPSETLSLTCTVSGGSISSSSYYCGWIRQPPGKGLDWIGSIYSTGYTYYNPSLKSRVTISIDTSKNQFSCLILTSVTAADTAVYYCAISTAAGPEYFHRWGQGTLVTVSS

SEQ ID NO: 179 - DNA, 361 bp, Homo Sapiens
cagctgcaggagtcgggcccaggcctggtgaagccttcggagaccctgtccctcacctgcactgtctctggtggctccatcagcagtagtagttattactgcggctggatccgccagccccctgggaaggggctggactggattgggagtatctattctactgggtacacctactacaacccgtccctcaagagtcgagtcaccatttccatagacacgtccaagaaccagttctcatgcctgatactgacctctgtgaccgccgcagacacggctgtgtattactgtgcgataagtacagcagctggccctgaatacttccatcgctggggccagggcaccctggtcaccgtctcctcag

SEQ ID NO: 180 - protein, 450 aa, Homo Sapiens
QLQESGPGLVKPSETLSLTCTVSGGSISSSSYYCGWIRQPPGKGLDWIGSIYSTGYTYYNPSLKSRVTISIDTSKNQFSCLILTSVTAADTAVYYCAISTAAGPEYFHRWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 181 - DNA, 1350 bp, Homo Sapiens
cagctgcaggagtcgggcccaggcctggtgaagccttcggagaccctgtccctcacctgcactgtctctggtggctccatcagcagtagtagttattactgcggctggatccgccagccccctgggaaggggctggactggattgggagtatctattctactgggtacacctactacaacccgtccctcaagagtcgagtcaccatttccatagacacgtccaagaaccagttctcatgcctgatactgacctctgtgaccgccgcagacacggctgtgtattactgtgcgataagtacagcagctggccctgaatacttccatcgctggggccagggcaccctggtcaccgtctcctcagccagcaccaagggcccctctgtgttccctctggccccttccagcaagtccacctctggcggaacagccgctctgggctgcctcgtgaaggactacttccccgagcctgtgaccgtgtcctggaactctggcgctctgaccagcggagtgcacaccttccctgctgtgctgcagtcctccggcctgtactccctgtcctccgtcgtgaccgtgccttccagctctctgggcacccagacctacatctgcaacgtgaaccacaagccctccaacaccaaggtggacaagaaggtggaacccaagtcctgcgacaagacccacacctgtcccccttgtcctgcccctgaactgctgggcggaccttccgtgttcctgttccccccaaagcccaaggacaccctgatgatctcccggacccccgaagtgacctgcgtggtggtggatgtgtcccacgaggaccctgaagtgaagttcaattggtacgtggacggcgtggaagtgcacaacgccaagaccaagcctagagaggaacagtacaactccacctaccgggtggtgtccgtgctgaccgtgctgcaccaggattggctgaacggcaaagagtacaagtgcaaggtgtccaacaaggccctgcctgcccccatcgaaaagaccatctccaaggccaagggccagccccgggaaccccaggtgtacacactgccccctagcagggacgagctgaccaagaaccaggtgtccctgacctgtctcgtgaaaggcttctacccctccgatatcgccgtggaatgggagtccaacggccagcctgagaacaactacaagaccaccccccctgtgctggactccgacggctcattcttcctgtacagcaagctgacagtggacaagtcccggtggcagcagggcaacgtgttctcctgctccgtgatgcacgaggccctgcacaaccactacacccagaagtccctgtccctgagccccggcaag

SEQ ID NO: 182 - protein, 12 aa, Homo Sapiens
QSVLYSSNSKNF

SEQ ID NO: 183 - protein, 3 aa, Homo Sapiens
WAS

SEQ ID NO: 184 - protein, 9 aa, Homo Sapiens
QQYYSTPRT

SEQ ID NO: 185 - protein, 17 aa, Homo Sapiens
KSSQSVLYSSNSKNFLA

SEQ ID NO: 186 - protein, 7 aa, Homo Sapiens
WASTRGS

SEQ ID NO: 187 - protein, 9 aa, Homo Sapiens
QQYYSTPRT

SEQ ID NO: 188 - protein, 113 aa, Homo Sapiens
DIVMTQSPDSLAVSLGERATINCKSSQSVLYSSNSKNFLAWYQQKPGQPPKLFIYWASTRGSGVPDRISGSGSGTDFNLTISSLQAEDVAVYYCQQYYSTPRTFGQGTKVEIK

SEQ ID NO: 189 - DNA, 340 bp, Homo Sapiens
gacatcgtgatgacccagtctccagactccctggctgtgtctctgggcgagagggccaccatcaactgcaagtccagccagagtgttttatacagctccaacagtaagaacttcttagcttggtaccagcagaaaccgggacagcctcctaagctgttcatttactgggcatctacccggggatccggggtccctgaccgaatcagtggcagcgggtctgggacagatttcaatctcaccatcagcagcctgcaggctgaagatgtggcagtttattactgtcaacaatattatagtactcctcggacgttcggccaagggaccaaggtggagatcaaac

SEQ ID NO: 190 - protein, 220 aa, Homo Sapiens
DIVMTQSPDSLAVSLGERATINCKSSQSVLYSSNSKNFLAWYQQKPGQPPKLFIYWASTRGSGVPDRISGSGSGTDFNLTISSLQAEDVAVYYCQQYYSTPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 191 - DNA, 660 bp, Homo Sapiens
gacatcgtgatgacccagtctccagactccctggctgtgtctctgggcgagagggccaccatcaactgcaagtccagccagagtgttttatacagctccaacagtaagaacttcttagcttggtaccagcagaaaccgggacagcctcctaagctgttcatttactgggcatctacccggggatccggggtccctgaccgaatcagtggcagcgggtctgggacagatttcaatctcaccatcagcagcctgcaggctgaagatgtggcagtttattactgtcaacaatattatagtactcctcggacgttcggccaagggaccaaggtggagatcaaacgtacggtggccgctccctccgtgttcatcttcccaccttccgacgagcagctgaagtccggcaccgcttctgtcgtgtgcctgctgaacaacttctacccccgcgaggccaaggtgcagtggaaggtggacaacgccctgcagtccggcaactcccaggaatccgtgaccgagcaggactccaaggacagcacctactccctgtcctccaccctgaccctgtccaaggccgactacgagaagcacaaggtgtacgcctgcgaagtgacccaccagggcctgtctagccccgtgaccaagtctttcaaccggggcgagtgt

SEQ ID NO: 192 - DNA, 981 bp, Homo Sapiens
gcttccaccaagggcccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccatcatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaa

SEQ ID NO: 193 - protein, 327 aa, Homo Sapiens
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 194 - DNA, 981 bp, Homo Sapiens
gcttccaccaagggcccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccgtgcccatcatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcgtgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacgcagaagagcctctccctgtctctgggtaaa

SEQ ID NO: 195 - protein, 327 aa, Homo Sapiens
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVVHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 196 - DNA, 981 bp, Homo Sapiens
gcttccaccaagggcccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccatcatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaagctcaccgtggacaagagcaggtggcaggaggggaacgtcttctcatgctccgtgatgcatgaggctctgcacaaccactacacgcagaagagcctctccctgtctctgggtaaa

SEQ ID NO: 197 - protein, 327 aa, Homo Sapiens
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSKLTVDKSRWQEGNVFSCSVMHEALHNHYTQKSLSLSLGK

SEQ ID NO: 198 - DNA, 981 bp, Homo Sapiens
gcctccaccaagggcccatccgtcttccccctggcgccctgctccaggagcacctccgagagcacggccgccctgggctgcctggtcaaggactacttccccgaaccagtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccaccatgcccagcgcctgaatttgaggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcatcgatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggatccttcttcctctacagcaggctaaccgtggacaagagcaggtggcaggaggggaatgtcttctcatgctccgtgatgcatgaggctctgcacaaccactacacacagaagagcctctccctgtctctgggtaaa

SEQ ID NO: 199 - protein, 327 aa, Homo Sapiens
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 200 - DNA, 981 bp, Homo Sapiens
gcctccaccaagggacctagcgtgttccctctcgccccctgttccaggtccacaagcgagtccaccgctgccctcggctgtctggtgaaagactactttcccgagcccgtgaccgtctcctggaatagcggagccctgacctccggcgtgcacacatttcccgccgtgctgcagagcagcggactgtatagcctgagcagcgtggtgaccgtgcccagctccagcctcggcaccaaaacctacacctgcaacgtggaccacaagccctccaacaccaaggtggacaagcgggtggagagcaagtacggccccccttgccctccttgtcctgcccctgagttcgagggaggaccctccgtgttcctgtttccccccaaacccaaggacaccctgatgatctcccggacacccgaggtgacctgtgtggtcgtggacgtcagccaggaggaccccgaggtgcagttcaactggtatgtggacggcgtggaggtgcacaatgccaaaaccaagcccagggaggagcagttcaattccacctacagggtggtgagcgtgctgaccgtcctgcatcaggattggctgaacggcaaggagtacaagtgcaaggtgtccaacaagggactgcccagctccatcgagaagaccatcagcaaggctaagggccagccgagggagccccaggtgtataccctgcctcctagccaggaagagatgaccaagaaccaagtgtccctgacctgcctggtgaagggattctacccctccgacatcgccgtggagtgggagagcaatggccagcccgagaacaactacaaaacaacccctcccgtgctcgatagcgacggcagcttctttctctacagccggctgacagtggacaagagcaggtggcaggagggcaacgtgttctcctgttccgtgatgcacgaggccctgcacaatcactacacccagaagagcctctccctgtccctgggcaag

SEQ ID NO: 201 - DNA, 981 bp, Homo Sapiens
gccagcaccaagggcccttccgtgttccccctggccccttgcagcaggagcacctccgaatccacagctgccctgggctgtctggtgaaggactactttcccgagcccgtgaccgtgagctggaacagcggcgctctgacatccggcgtccacacctttcctgccgtcctgcagtcctccggcctctactccctgtcctccgtggtgaccgtgcctagctcctccctcggcaccaagacctacacctgtaacgtggaccacaaaccctccaacaccaaggtggacaaacgggtcgagagcaagtacggccctccctgccctccttgtcctgcccccgagttcgaaggcggacccagcgtgttcctgttccctcctaagcccaaggacaccctcatgatcagccggacacccgaggtgacctgcgtggtggtggatgtgagccaggaggaccctgaggtccagttcaactggtatgtggatggcgtggaggtgcacaacgccaagacaaagccccgggaagagcagttcaactccacctacagggtggtcagcgtgctgaccgtgctgcatcaggactggctgaacggcaaggagtacaagtgcaaggtcagcaataagggactgcccagcagcatcgagaagaccatctccaaggctaaaggccagccccgggaacctcaggtgtacaccctgcctcccagccaggaggagatgaccaagaaccaggtgagcctgacctgcctggtgaagggattctacccttccgacatcgccgtggagtgggagtccaacggccagcccgagaacaattataagaccacccctcccgtcctcgacagcgacggatccttctttctgtactccaggctgaccgtggataagtccaggtggcaggaaggcaacgtgttcagctgctccgtgatgcacgaggccctgcacaatcactacacccagaagtccctgagcctgtccctgggaaag

SEQ ID NO: 202 - DNA, 981 bp, Homo Sapiens
gcctccaccaagggcccatccgtcttccccctggcgccctgctccaggagcacctccgagagcacggccgccctgggctgcctggtcaaggactacttccccgaaccagtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccaccatgcccagcgcctccagttgcggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcatcgatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggatccttcttcctctacagcaggctaaccgtggacaagagcaggtggcaggaggggaatgtcttctcatgctccgtgatgcatgaggctctgcacaaccactacacacagaagagcctctccctgtctctgggtaaa

SEQ ID NO: 203 - protein, 327 aa, Homo Sapiens
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPPVAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 204 - DNA, 990 bp, Homo Sapiens
gcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagtggagcccaaatcttgtgacaaaactcacacatgcccaccgtgcccagcacctgaactcgcgggggcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 205 - protein, 330 aa, Homo Sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 206 - DNA, 321 bp, Homo Sapiens
cgtacggtggccgctccctccgtgttcatcttcccaccttccgacgagcagctgaagtccggcaccgcttctgtcgtgtgcctgctgaacaacttctacccccgcgaggccaaggtgcagtggaaggtggacaacgccctgcagtccggcaactcccaggaatccgtgaccgagcaggactccaaggacagcacctactccctgtcctccaccctgaccctgtccaaggccgactacgagaagcacaaggtgtacgcctgcgaagtgacccaccagggcctgtctagccccgtgaccaagtctttcaaccggggcgagtgt

SEQ ID NO: 207 - protein, 107 aa, Homo Sapiens [sequence omitted]

SEQ ID NO: 208 - DNA, 321 bp, Homo Sapiens
cgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggagagcaaggacagcacctacagcctcagcagcaccctgacgctgagcaaagcagactacgagaaacacaaagtctacgccggcgaagtcacccatcagggcctgagctcgcccgtcacaaagagcttcaacaggggagagtgt

SEQ ID NO: 209 - protein, 107 aa, Homo Sapiens
RTVAAPSVFIFPPSDEQLKSGTASVVCLLNNFYPREAKVQWKVDNALQSGNSQESVTEQESKDSTYSLSSTLTLSKADYEKHKVYAGEVTHQGLSSPVTKSFNRGEC

SEQ ID NO: 210 - DNA, 321 bp, Homo Sapiens
cgaactgtggctgcaccatctgtcttcatcttcccgccatctgatgagcagttgaaatctggaactgcctctgttgtgtgcctgctgaataacttctatcccagagaggccaaagtacagcggaaggtggataacgccctccaatcgggtaactcccaggagagtgtcacagagcaggagagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 211 - protein, 107 aa, Homo Sapiens
RTVAAPSVFIFPPSDEQLKSGTASVVCLLNNFYPREAKVQRKVDNALQSGNSQESVTEQESKDSTYSLSSTLTLSKADYEKHKVYACEVTHQGLSSPVTKSFNRGEC

SEQ ID NO: 212 - DNA, 321 bp, Homo Sapiens
cgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaactctacgcctgcgaagtcacccatcagggcctgagctcgcccgtcacaaagagcttcaacaggggagagtgt

SEQ ID NO: 213 - protein, 107 aa, Homo Sapiens
RTVAAPSVFIFPPSDEQLKSGTASVVCLLNNFYPREAKVQWKVDNALQSGNSQESVTEQDSKDSTYSLSSTLTLSKADYEKHKLYACEVTHQGLSSPVTKSFNRGEC

SEQ ID NO: 214 - DNA, 321 bp, Homo Sapiens
cgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcaacaccctgacgctgagcaaagcagactacgagaaacacaaagtctacgcctgcgaagtcacccatcagggcctgagctcgcccgtcacaaagagcttcaacaggggagagtgc

SEQ ID NO: 215 - protein, 107 aa, Homo Sapiens
RTVAAPSVFIFPPSDEQLKSGTASVVCLLNNFYPREAKVQWKVDNALQSGNSQESVTEQDSKDSTYSLSNTLTLSKADYEKHKVYACEVTHQGLSSPVTKSFNRGEC

SEQ ID NO: 216 - DNA, 312 bp, Homo Sapiens
cccaaggccaaccccacggtcactctgttcccgccctcctctgaggagctccaagccaacaaggccacactagtgtgtctgatcagtgacttctacccgggagctgtgacagtggcttggaaggcagatggcagccccgtcaaggcgggagtggagacgaccaaaccctccaaacagagcaacaacaagtacgcggccagcagctacctgagcctgacgcccgagcagtggaagtcccacagaagctacagctgccaggtcacgcatgaagggagcaccgtggagaagacagtggcccctacagaatgttca

SEQ ID NO: 217 - protein, 104 aa, Homo Sapiens
PKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 218 - DNA, 318 bp, Homo Sapiens
ggtcagcccaaggccaaccccactgtcactctgttcccgccctcctctgaggagctccaagccaacaaggccacactagtgtgtctgatcagtgacttctacccgggagctgtgacagtggcctggaaggcagatggcagccccgtcaaggcgggagtggagaccaccaaaccctccaaacagagcaacaacaagtacgcggccagcagctacctgagcctgacgcccgagcagtggaagtcccacagaagctacagctgccaggtcacgcatgaagggagcaccgtggagaagacagtggcccctacagaatgttca

SEQ ID NO: 219 - protein, 106 aa, Homo Sapiens
GQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 220 - DNA, 318 bp, Homo Sapiens; identical to SEQ ID NO: 218

SEQ ID NO: 221 - DNA, 318 bp, Homo Sapiens
ggccagcctaaggccgctccttctgtgaccctgttccccccatcctccgaggaactgcaggctaacaaggccaccctcgtgtgcctgatcagcgacttctaccctggcgccgtgaccgtggcctggaaggctgatagctctcctgtgaaggccggcgtggaaaccaccaccccttccaagcagtccaacaacaaatacgccgcctcctcctacctgtccctgacccctgagcagtggaagtcccaccggtcctacagctgccaagtgacccacgagggctccaccgtggaaaagaccgtggctcctaccgagtgctcc

SEQ ID NO: 222 - DNA, 318 bp, Homo Sapiens
ggccagcctaaagctgcccccagcgtcaccctgtttcctccctccagcgaggagctccaggccaacaaggccaccctcgtgtgcctgatctccgacttctatcccggcgctgtgaccgtggcttggaaagccgactccagccctgtcaaagccggcgtggagaccaccacaccctccaagcagtccaacaacaagtacgccgcctccagctatctctccctgacccctgagcagtggaagtcccaccggtcctactcctgtcaggtgacccacgagggctccaccgtggaaaagaccgtcgcccccaccgagtgctcc

SEQ ID NO: 223 - protein, 106 aa, Homo Sapiens; identical to SEQ ID NO: 219

SEQ ID NO: 224 - DNA, 318 bp, Homo Sapiens
ggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 225 - protein, 106 aa, Homo Sapiens
GQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 226 - DNA, 312 bp, Homo Sapiens
cccaaggctgccccctcggtcactctgttcccaccctcctctgaggagcttcaagccaacaaggccacactggtgtgtctcataagtgacttctacccgggagccgtgacagttgcctggaaggcagatagcagccccgtcaaggcgggggtggagaccaccacaccctccaaacaaagcaacaacaagtacgcggccagcagctacctgagcctgacgcctgagcagtggaagtcccacaaaagctacagctgccaggtcacgcatgaagggagcaccgtggagaagacagttgcccctacggaatgttca

SEQ ID NO: 227 - protein, 104 aa, Homo Sapiens
PKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPTECS

SEQ ID NO: 228 - DNA, 318 bp, Homo Sapiens
ggtcagcccaaggctgccccctcggtcactctgttcccaccctcctctgaggagcttcaagccaacaaggccacactggtgtgtctcataagtgacttctacccggggccagtgacagttgcctggaaggcagatagcagccccgtcaaggcgggggtggagaccaccacaccctccaaacaaagcaacaacaagtacgcggccagcagctacctgagcctgacgcctgagcagtggaagtcccacaaaagctacagctgccaggtcacgcatgaagggagcaccgtggagaagacagtggcccctacggaatgttca

SEQ ID NO: 229 - protein, 106 aa, Homo Sapiens
GQPKAAPSVTLFPPSSEELQANKATLVCLISDFYPGPVTVAWKADSSPVKAGVETTTPSKQSNNKYAASSYLSLTPEQWKSHKSYSCQVTHEGSTVEKTVAPTECS

SEQ ID NO: 230 - DNA, 318 bp, Homo Sapiens
ggtcagcccaaggctgccccctcggtcactctgttcccaccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacaaaagctacagctgccaggtcacgcatgaagggagcaccgtggagaagacagtggcccctacagaatgttca

SEQ ID NO: 231 - protein, 106 aa, Homo Sapiens
GQPKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPTECS

SEQ ID NO: 232 - DNA, 318 bp, Homo Sapiens
ggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacagaagctacagctgccaggtcacgcatgaagggagcaccgtggagaagacagtggcccctacagaatgttca

SEQ ID NO: 233 - protein, 106 aa, Homo Sapiens; identical to SEQ ID NO: 225

SEQ ID NO: 234 - DNA, 318 bp, Homo Sapiens
ggtcagcccaaggctgccccatcggtcactctgttcccgccctcctctgaggagcttcaagccaacaaggccacactggtgtgcctgatcagtgacttctacccgggagctgtgaaagtggcctggaaggcagatggcagccccgtcaacacgggagtggagaccaccacaccctccaaacagagcaacaacaagtacgcggccagcagctacctgagcctgacgcctgagcagtggaagtcccacagaagctacagctgccaggtcacgcatgaagggagcaccgtggagaagacagtggcccctgcagaatgttca

SEQ ID NO: 235 - protein, 106 aa, Homo Sapiens
GQPKAAPSVTLFPPSSEELQANKATLVCLISDFYPGAVKVAWKADGSPVNTGVETTTPSKQSNNKYAASSYLSLTPEQWKSHRSYSCQVTHEGSTVEKTVAPAECS

SEQ ID NO: 236 - DNA, 318 bp, Homo Sapiens
ggtcagcccaaggctgccccatcggtcactctgttcccaccctcctctgaggagcttcaagccaacaaggccacactggtgtgtctcgtaagtgacttctacccgggagccgtgacagtggcctggaaggcagatggcagccccgtcaaggtgggagtggagaccaccaaaccctccaaacaaagcaacaacaagtatgcggccagcagctacctgagcctgacgcccgagcagtggaagtcccacagaagctacagctgccgggtcacgcatgaagggagcaccgtggagaagacagtggcccctgcagaatgctct

SEQ ID NO: 237 - protein, 106 aa, Homo Sapiens
GQPKAAPSVTLFPPSSEELQANKATLVCLVSDFYPGAVTVAWKADGSPVKVGVETTKPSKQSNNKYAASSYLSLTPEQWKSHRSYSCRVTHEGSTVEKTVAPAECS

SEQ ID NO: 238 - protein, 8 aa, Homo Sapiens
GFTFSDYY

SEQ ID NO: 239 - protein, 8 aa, Homo Sapiens
ISTSGSTI

SEQ ID NO: 240 - protein, 16 aa, Homo Sapiens
ARGITGTNFYHYGLGV

SEQ ID NO: 241 - protein, 5 aa, Homo Sapiens
DYYMS

SEQ ID NO: 242 - protein, 17 aa, Homo Sapiens
YISTSGSTIYYADSVKG

SEQ ID NO: 243 - protein, 14 aa, Homo Sapiens
GITGTNFYHYGLGV

SEQ ID NO: 244 - protein, 123 aa, Homo Sapiens
QVQLVESGGGLVKPGGSLRLSCAASGFTFSDYYMSWIRQVPGKGLEWVSYISTSGSTIYYADSVKGRFTISRDNAKNSLYLQMNSLRAEDAAVYHCARGITGTNFYHYGLGVWGQGTTVTVSS

SEQ ID NO: 245 - DNA, 370 bp, Homo Sapiens
caggtgcagctggtggagtctgggggaggcttggtcaagcctggagggtccctgagactctcctgtgcagcctctggattcaccttcagtgactactacatgagctggatccgccaggttccagggaaggggctggagtgggtttcatacattagtactagtggtagtaccatatactacgcagactctgtgaagggccgattcaccatctccagggacaacgccaagaactcactgtatctacaaatgaacagcctgagagccgaggacgcggccgtgtatcactgtgcgagaggtataactggaactaacttctaccactacggtttgggcgtctggggccaagggaccacggtcaccgtctcctcag

SEQ ID NO: 246 - protein, 453 aa, Homo Sapiens
QVQLVESGGGLVKPGGSLRLSCAASGFTFSDYYMSWIRQVPGKGLEWVSYISTSGSTIYYADSVKGRFTISRDNAKNSLYLQMNSLRAEDAAVYHCARGITGTNFYHYGLGVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 247 - DNA, 1359 bp, Homo Sapiens
caggtgcagctggtggagtctgggggaggcttggtcaagcctggagggtccctgagactctcctgtgcagcctctggattcaccttcagtgactactacatgagctggatccgccaggttccagggaaggggctggagtgggtttcatacattagtactagtggtagtaccatatactacgcagactctgtgaagggccgattcaccatctccagggacaacgccaagaactcactgtatctacaaatgaacagcctgagagccgaggacgcggccgtgtatcactgtgcgagaggtataactggaactaacttctaccactacggtttgggcgtctggggccaagggaccacggtcaccgtctcctcagccagcaccaagggcccctctgtgttccctctggccccttccagcaagtccacctctggcggaacagccgctctgggctgcctcgtgaaggactacttccccgagcctgtgaccgtgtcctggaactctggcgctctgaccagcggagtgcacaccttccctgctgtgctgcagtcctccggcctgtactccctgtcctccgtcgtgaccgtgccttccagctctctgggcacccagacctacatctgcaacgtgaaccacaagccctccaacaccaaggtggacaagaaggtggaacccaagtcctgcgacaagacccacacctgtcccccttgtcctgcccctgaactgctgggcggaccttccgtgttcctgttccccccaaagcccaaggacaccctgatgatctcccggacccccgaagtgacctgcgtggtggtggatgtgtcccacgaggaccctgaagtgaagttcaattggtacgtggacggcgtggaagtgcacaacgccaagaccaagcctagagaggaacagtacaactccacctaccgggtggtgtccgtgctgaccgtgctgcaccaggattggctgaacggcaaagagtacaagtgcaaggtgtccaacaaggccctgcctgcccccatcgaaaagaccatctccaaggccaagggccagccccgggaaccccaggtgtacacactgccccctagcagggacgagctgaccaagaaccaggtgtccctgacctgtctcgtgaaaggcttctacccctccgatatcgccgtggaatgggagtccaacggccagcctgagaacaactacaagaccaccccccctgtgctggactccgacggctcattcttcctgtacagcaagctgacagtggacaagtcccggtggcagcagggcaacgtgttctcctgctccgtgatgcacgaggccctgcacaaccactacacccagaagtccctgtccctgagccccggcaag

SEQ ID NO: 248 - protein, 6 aa, Homo Sapiens
QGINSW

SEQ ID NO: 249 - protein, 3 aa, Homo Sapiens
AAS

SEQ ID NO: 250 - protein, 9 aa, Homo Sapiens
QQVNSFPLT

SEQ ID NO: 251 - protein, 11 aa, Homo Sapiens
RASQGINSWLA

SEQ ID NO: 252 - protein, 7 aa, Homo Sapiens
AASTLQS

SEQ ID NO: 253 - protein, 9 aa, Homo Sapiens
QQVNSFPLT

SEQ ID NO: 254 - protein, 107 aa, Homo Sapiens
DIQMTQSPSSVSASVGDRVTITCRASQGINSWLAWYQQKPGKAPKLLIYAASTLQSGVPSRFSGSGSGADFTLTISSLQPEDFATYYCQQVNSFPLTFGGGTKVEIK

SEQ ID NO: 255 - DNA, 322 bp, Homo Sapiens
gacatccagatgacccagtctccatcttccgtgtctgcatctgtaggagacagagtcaccatcacttgtcgggcgagtcagggtattaacagctggttagcctggtatcagcagaaaccagggaaagcccctaagctcctgatctatgctgcatccactttgcaaagtggggtcccatcaaggttcagcggcagtgggtctggggcagatttcactctcaccatcagcagcctgcagcctgaagattttgcaacttactattgtcaacaggttaacagtttcccgctcactttcggcggagggaccaaggtggagatcaaac

SEQ ID NO: 256 - protein, 214 aa, Homo Sapiens
DIQMTQSPSSVSASVGDRVTITCRASQGINSWLAWYQQKPGKAPKLLIYAASTLQSGVPSRFSGSGSGADFTLTISSLQPEDFATYYCQQVNSFPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 257 - DNA, 642 bp, Homo Sapiens
gacatccagatgacccagtctccatcttccgtgtctgcatctgtaggagacagagtcaccatcacttgtcgggcgagtcagggtattaacagctggttagcctggtatcagcagaaaccagggaaagcccctaagctcctgatctatgctgcatccactttgcaaagtggggtcccatcaaggttcagcggcagtgggtctggggcagatttcactctcaccatcagcagcctgcagcctgaagattttgcaacttactattgtcaacaggttaacagtttcccgctcactttcggcggagggaccaaggtggagatcaaacgtacggtggccgctccctccgtgttcatcttcccaccttccgacgagcagctgaagtccggcaccgcttctgtcgtgtgcctgctgaacaacttctacccccgcgaggccaaggtgcagtggaaggtggacaacgccctgcagtccggcaactcccaggaatccgtgaccgagcaggactccaaggacagcacctactccctgtcctccaccctgaccctgtccaaggccgactacgagaagcacaaggtgtacgcctgcgaagtgacccaccagggcctgtctagccccgtgaccaagtctttcaaccggggcgagtgt

SEQ ID NO: 258 - protein, 8 aa, Homo Sapiens
GFTFSYYA

SEQ ID NO: 259 - protein, 8 aa, Homo Sapiens
ISGGGGNT

SEQ ID NO: 260 - protein, 16 aa, Homo Sapiens
AKDRMKQLVRAYYFDY

SEQ ID NO: 261 - protein, 5 aa, Homo Sapiens
YYAMS

SEQ ID NO: 262 - protein, 17 aa, Homo Sapiens
TISGGGGNTHYADSVKG

SEQ ID NO: 263 - protein, 14 aa, Homo Sapiens
DRMKQLVRAYYFDY

SEQ ID NO: 264 - protein, 123 aa, Homo Sapiens
EVPLVESGGGLVQPGGSLRLSCAASGFTFSYYAMSWVRQAPGKGLDWVSTISGGGGNTHYADSVKGRFTISRDNSKNTLYLHMNSLRAEDTAVYYCAKDRMKQLVRAYYFDYWGQGTLVTVSS

SEQ ID NO: 265 - DNA, 370 bp, Homo Sapiens
gaggtgccgctggtggagtctgggggaggcttggtacagcctggggggtccctgagactctcctgtgcagcctctggattcacgtttagctactatgccatgagctgggtccgtcaggctccagggaaggggctggactgggtctcaactattagtggtggtggtggtaacacacactacgcagactccgtgaagggccgattcactatatccagagacaattccaagaacacgctgtatctgcacatgaacagcctgagagccgaagacacggccgtctattactgtgcgaaggatcggatgaaacagctcgtccgggcctactactttgactactggggccagggaaccctggtcaccgtctcctcag

SEQ ID NO: 266 - protein, 453 aa, Homo Sapiens
EVPLVESGGGLVQPGGSLRLSCAASGFTFSYYAMSWVRQAPGKGLDWVSTISGGGGNTHYADSVKGRFTISRDNSKNTLYLHMNSLRAEDTAVYYCAKDRMKQLVRAYYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 267 - DNA, 1359 bp, Homo Sapiens
gaggtgccgctggtggagtctgggggaggcttggtacagcctggggggtccctgagactctcctgtgcagcctctggattcacgtttagctactatgccatgagctgggtccgtcaggctccagggaaggggctggactgggtctcaactattagtggtggtggtggtaacacacactacgcagactccgtgaagggccgattcactatatccagagacaattccaagaacacgctgtatctgcacatgaacagcctgagagccgaagacacggccgtctattactgtgcgaaggatcggatgaaacagctcgtccgggcctactactttgactactggggccagggaaccctggtcaccgtctcctcagccagcaccaagggcccctctgtgttccctctggccccttccagcaagtccacctctggcggaacagccgctctgggctgcctcgtgaaggactacttccccgagcctgtgaccgtgtcctggaactctggcgctctgaccagcggagtgcacaccttccctgctgtgctgcagtcctccggcctgtactccctgtcctccgtcgtgaccgtgccttccagctctctgggcacccagacctacatctgcaacgtgaaccacaagccctccaacaccaaggtggacaagaaggtggaacccaagtcctgcgacaagacccacacctgtcccccttgtcctgcccctgaactgctgggcggaccttccgtgttcctgttccccccaaagcccaaggacaccctgatgatctcccggacccccgaagtgacctgcgtggtggtggatgtgtcccacgaggaccctgaagtgaagttcaattggtacgtggacggcgtggaagtgcacaacgccaagaccaagcctagagaggaacagtacaactccacctaccgggtggtgtccgtgctgaccgtgctgcaccaggattggctgaacggcaaagagtacaagtgcaaggtgtccaacaaggccctgcctgcccccatcgaaaagaccatctccaaggccaagggccagccccgggaaccccaggtgtacacactgccccctagcagggacgagctgaccaagaaccaggtgtccctgacctgtctcgtgaaaggcttctacccctccgatatcgccgtggaatgggagtccaacggccagcctgagaacaactacaagaccaccccccctgtgctggactccgacggctcattcttcctgtacagcaagctgacagtggacaagtcccggtggcagcagggcaacgtgttctcctgctccgtgatgcacgaggccctgcacaaccactacacccagaagtccctgtccctgagccccggcaag

SEQ ID NO: 268 - protein, 6 aa, Homo Sapiens
QDISTY

SEQ ID NO: 269 - protein, 3 aa, Homo Sapiens
GTS

SEQ ID NO: 270 - protein, 9 aa, Homo Sapiens
QQLHTDPIT

SEQ ID NO: 271 - protein, 11 aa, Homo Sapiens
WASQDISTYLG

SEQ ID NO: 272 - protein, 7 aa, Homo Sapiens
GTSSLQS

SEQ ID NO: 273 - protein, 9 aa, Homo Sapiens
QQLHTDPIT

SEQ ID NO: 274 - protein, 107 aa, Homo Sapiens
DIQLTQSPSFLSASVGDRVTITCWASQDISTYLGWYQQKPGKAPKLLIYGTSSLQSGVPSRFSGSGSGTEFTLTISSLQPEDFATYYCQQLHTDPITFGQGTRLEIK

SEQ ID NO: 275 - DNA, 322 bp, Homo Sapiens
gacatccagttgacccagtctccatccttcctgtctgcatctgtaggagacagagtcaccatcacttgctgggccagtcaggacattagcacttatttaggctggtatcagcaaaaaccagggaaagcccctaagctcctgatctatggtacatccagtttgcaaagtggggtcccatcaaggttcagcggcagtggatctgggacagaattcactctcacaatcagcagcctgcagcctgaagattttgcaacttattactgtcaacagcttcatactgacccgatcaccttcggccaagggacacgactggagatcaaac

SEQ ID NO: 276 - protein, 214 aa, Homo Sapiens
DIQLTQSPSFLSASVGDRVTITCWASQDISTYLGWYQQKPGKAPKLLIYGTSSLQSGVPSRFSGSGSGTEFTLTISSLQPEDFATYYCQQLHTDPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 277 - DNA, 642 bp, Homo Sapiens
gacatccagttgacccagtctccatccttcctgtctgcatctgtaggagacagagtcaccatcacttgctgggccagtcaggacattagcacttatttaggctggtatcagcaaaaaccagggaaagcccctaagctcctgatctatggtacatccagtttgcaaagtggggtcccatcaaggttcagcggcagtggatctgggacagaattcactctcacaatcagcagcctgcagcctgaagattttgcaacttattactgtcaacagcttcatactgacccgatcaccttcggccaagggacacgactggagatcaaacgtacggtggccgctccctccgtgttcatcttcccaccttccgacgagcagctgaagtccggcaccgcttctgtcgtgtgcctgctgaacaacttctacccccgcgaggccaaggtgcagtggaaggtggacaacgccctgcagtccggcaactcccaggaatccgtgaccgagcaggactccaaggacagcacctactccctgtcctccaccctgaccctgtccaaggccgactacgagaagcacaaggtgtacgcctgcgaagtgacccaccagggcctgtctagccccgtgaccaagtctttcaaccggggcgagtgt

SEQ ID NO: 278 - protein, 8 aa, Homo Sapiens
GFTFSSYW

SEQ ID NO: 279 - protein, 8 aa, Homo Sapiens
IKQDGSEK

SEQ ID NO: 280 - protein, 12 aa, Homo Sapiens
ARVRQWSDYSDY

SEQ ID NO: 281 - protein, 5 aa, Homo Sapiens
SYWMN

SEQ ID NO: 282 - protein, 17 aa, Homo Sapiens
NIKQDGSEKYYVDSVKG

SEQ ID NO: 283 - protein, 10 aa, Homo Sapiens
VRQWSDYSDY

SEQ ID NO: 284 - protein, 119 aa, Homo Sapiens
EVHLVESGGGLVQPGGSLRLSCAASGFTFSSYWMNWVRQAPGKGLEWVANIKQDGSEKYYVDSVKGRFTVSRDNAKNSLYLQMNSLRAEDTAVYYCARVRQWSDYSDYWGQGTPVTVSS

SEQ ID NO: 285 - DNA, 358 bp, Homo Sapiens
gaggtgcacctggtggagtctgggggaggcttggtccagcctggggggtccctgagactctcctgtgcagcctctggattcacctttagtagctattggatgaactgggtccgccaggctccagggaaggggctggagtgggtggccaacataaagcaagatggaagtgagaaatactatgtggactctgtgaagggccgcttcaccgtctccagagacaacgccaagaactcactgtatctgcaaatgaacagcctgagagccgaggacacggctgtgtattactgtgcgagagttcgacaatggtccgactactctgactactggggccagggaaccccggtcaccgtctcctcag

SEQ ID NO: 286 - protein, 449 aa, Homo Sapiens
EVHLVESGGGLVQPGGSLRLSCAASGFTFSSYWMNWVRQAPGKGLEWVANIKQDGSEKYYVDSVKGRFTVSRDNAKNSLYLQMNSLRAEDTAVYYCARVRQWSDYSDYWGQGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 287 - DNA, 1347 bp, Homo Sapiens
gaggtgcacctggtggagtctgggggaggcttggtccagcctggggggtccctgagactctcctgtgcagcctctggattcacctttagtagctattggatgaactgggtccgccaggctccagggaaggggctggagtgggtggccaacataaagcaagatggaagtgagaaatactatgtggactctgtgaagggccgcttcaccgtctccagagacaacgccaagaactcactgtatctgcaaatgaacagcctgagagccgaggacacggctgtgtattactgtgcgagagttcgacaatggtccgactactctgactactggggccagggaaccccggtcaccgtctcctcagccagcaccaagggcccctctgtgttccctctggccccttccagcaagtccacctctggcggaacagccgctctgggctgcctcgtgaaggactacttccccgagcctgtgaccgtgtcctggaactctggcgctctgaccagcggagtgcacaccttccctgctgtgctgcagtcctccggcctgtactccctgtcctccgtcgtgaccgtgccttccagctctctgggcacccagacctacatctgcaacgtgaaccacaagccctccaacaccaaggtggacaagaaggtggaacccaagtcctgcgacaagacccacacctgtcccccttgtcctgcccctgaactgctgggcggaccttccgtgttcctgttccccccaaagcccaaggacaccctgatgatctcccggacccccgaagtgacctgcgtggtggtggatgtgtcccacgaggaccctgaagtgaagttcaattggtacgtggacggcgtggaagtgcacaacgccaagaccaagcctagagaggaacagtacaactccacctaccgggtggtgtccgtgctgaccgtgctgcaccaggattggctgaacggcaaagagtacaagtgcaaggtgtccaacaaggccctgcctgcccccatcgaaaagaccatctccaaggccaagggccagccccgggaaccccaggtgtacacactgccccctagcagggacgagctgaccaagaaccaggtgtccctgacctgtctcgtgaaaggcttctacccctccgatatcgccgtggaatgggagtccaacggccagcctgagaacaactacaagaccaccccccctgtgctggactccgacggctcattcttcctgtacagcaagctgacagtggacaagtcccggtggcagcagggcaacgtgttctcctgctccgtgatgcacgaggccctgcacaaccactacacccagaagtccctgtccctgagccccggcaag

SEQ ID NO: 288 - protein, 6 aa, Homo Sapiens
QGISSW

SEQ ID NO: 289 - protein, 3 aa, Homo Sapiens
AAS

SEQ ID NO: 290 - protein, 9 aa, Homo Sapiens
QQANSFPFT

SEQ ID NO: 291 - protein, 11 aa, Homo Sapiens
RASQGISSWLA

SEQ ID NO: 292 - protein, 7 aa, Homo Sapiens
AASSLQS

SEQ ID NO: 293 - protein, 9 aa, Homo Sapiens
QQANSFPFT

SEQ ID NO: 294 - protein, 107 aa, Homo Sapiens
DIQMTQSPSSVSASVGDRVTITCRASQGISSWLAWYQQKPGKAPKLLIYAASSLQSGVPSRFSGSGSGTDFTLTISSLQPEDFATYYCQQANSFPFTFGPGTKVDIK

SEQ ID NO: 295 - DNA, 322 bp, Homo Sapiens
gacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccagtttgcaaagtggggtcccatcaaggttcagcggcagtggatctgggacagatttcactctcaccatcagcagcctgcagcctgaagattttgcaacttactattgtcaacaggctaacagtttcccattcactttcggccctgggaccaaagtggatatcaaac

SEQ ID NO: 296 - protein, 214 aa, Homo Sapiens
DIQMTQSPSSVSASVGDRVTITCRASQGISSWLAWYQQKPGKAPKLLIYAASSLQSGVPSRFSGSGSGTDFTLTISSLQPEDFATYYCQQANSFPFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 297 - DNA, 642 bp, Homo Sapiens
gacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccagtttgcaaagtggggtcccatcaaggttcagcggcagtggatctgggacagatttcactctcaccatcagcagcctgcagcctgaagattttgcaacttactattgtcaacaggctaacagtttcccattcactttcggccctgggaccaaagtggatatcaaacgtacggtggccgctccctccgtgttcatcttcccaccttccgacgagcagctgaagtccggcaccgcttctgtcgtgtgcctgctgaacaacttctacccccgcgaggccaaggtgcagtggaaggtggacaacgccctgcagtccggcaactcccaggaatccgtgaccgagcaggactccaaggacagcacctactccctgtcctccaccctgaccctgtccaaggccgactacgagaagcacaaggtgtacgcctgcgaagtgacccaccagggcctgtctagccccgtgaccaagtctttcaaccggggcgagtgt

SEQ ID NO: 298 - protein, 214 aa, Homo Sapiens
DIQMTQSPSSLSASVGDRVTITCRASQSISSYLNWYQQKPGKAPKLLIYYASSLQSGVPSRFSGSGSGTDFTLTISSLQPEDFATYYCQQSYSTPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 299 - protein, 453 aa, Homo Sapiens
EVQLVESGGGLVQPGRSLRLSCAASGFTFDDYAMHWVRQVPGKGLEWVSGISWIRTGIGYADSVKGRFTIFRDNAKNSLYLQMNSLRAEDTALYYCAKDMKGSGTYGGWFDTWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 300 - protein, 347 aa, Homo Sapiens
DIQMTQSPSSLSASVGDRVTITCRASQSISSYLNWYQQKPGKAPKLLIYVASSLQSGVPSRFSGSGSGTDFTLTISSLQPEDFATYYCQQSYSTPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLT

SEQ ID NO: 301 - protein, 133 aa, Homo Sapiens [sequence omitted]

SEQ ID NO: 302 - protein, 586 aa, Homo Sapiens
EVQLVESGGGLVQPGRSLRLSCAASGFTFDDYAMHWVRQVPGKGLEWVSGISWIRTGIGYADSVKGRFTIFRDNAKNSLYLQMNSLRAEDTALYYCAKDMKGSGTYGGWFDTWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLT

SEQ ID NO: 303 - protein, 14 aa, Homo Sapiens
APTSTQLQLELLLD

SEQ ID NO: 304 - protein, 11 aa, Homo Sapiens
TQLQLEHLLLD

SEQ ID NO: 305 - protein, 17 aa, Homo Sapiens
APTSKKTQLQLEHLLLD

SEQ ID NO: 306 - protein, 19 aa, Homo Sapiens
PTSSSTKKTQLQLEHLLLD

SEQ ID NO: 307 - protein, 18 aa, Homo Sapiens
TSSSTKKTQLQLEHLLLD

SEQ ID NO: 308 - protein, 17 aa, Homo Sapiens
SSSTKKTQLQLEHLLLD

SEQ ID NO: 309 - protein, 16 aa, Homo Sapiens
SSTKKTQLQLEHLLLD

SEQ ID NO: 310 - protein, 15 aa, Homo Sapiens
STKKTQLQLEHLLLD

SEQ ID NO: 311 - protein, 14 aa, Homo Sapiens
TKKTQLQLEHLLLD

SEQ ID NO: 312 - protein, 13 aa, Homo Sapiens
KKTQLQLEHLLLD

SEQ ID NO: 313 - protein, 12 aa, Homo Sapiens
KTQLQLEHLLLD

SEQ ID NO: 314 - protein, 19 aa, Homo Sapiens
APTSSSTKTQLQLEHLLLD

SEQ ID NO: 315 - protein, 18 aa, Homo Sapiens
APTSSSTTQLQLEHLLLD

SEQ ID NO: 316 - protein, 17 aa, Homo Sapiens
APTSSSTQLQLEHLLLD

SEQ ID NO: 317 - protein, 16 aa, Homo Sapiens
APTSSTQLQLEHLLLD

SEQ ID NO: 318 - protein, 14 aa, Homo Sapiens
APTTQLQLEHLLLD

SEQ ID NO: 319 - protein, 13 aa, Homo Sapiens
APTQLQLEHLLLD

SEQ ID NO: 320 - protein, 12 aa, Homo Sapiens
ATQLQLEHLLLD

SEQ ID NO: 321 - protein, 15 aa, Homo Sapiens
ATKKTQLQLEHLLLD

SEQ ID NO: 322 - protein, 15 aa, Homo Sapiens
APKKTQLQLEHLLLD

SEQ ID NO: 323 - protein, 15 aa, Homo Sapiens
APTKTQLQLEHLLLD

SEQ ID NO: 324 - protein, 113 aa, Homo Sapiens
LQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLT

SEQ ID NO: 325 - protein, 290 aa, Mus Musculus
MRIFAGIIFTACCHLLRAFTITAPKDLYVVEYGSNVTMECRFPVERELDLLALVVYWEKEDEQVIQFVAGEEDLKPQHSNFRGRASLPKDQLLKGNAALQITDVKLQDAGVYCCIISYGGADYKRITLKVNAPYRKINQRISVDPATSEHELICQAEGYPEAEVIWTNSDHQPVSGKRSVTTSRTEGMLLNVTSSLRVNATANDVFYCTFWRSQPGQNHTAELIIPELPATHPPQNRTHWVLLGSILLFLIVVSTVLLFLRKQVRMLDVEKCGVEDTSSKNRNDTQFEET

SEQ ID NO: 326 - protein, 226 aa, Mus Musculus
FTITAPKDLYVVEYGSNVTMECRFPVERELDLLALVVYWEKEDEQVIQFVAGEEDLKPQHSNFRGRASLPKDQLLKGNAALQITDVKLQDAGVYCCIISYGGADYKRITLKVNAPYRKINQRISVDPATSEHELICQAEGYPEAEVIWTNSDHQPVSGKRSVTTSRTEGMLLNVTSSLRVNATANDVFYCTFWRSQPGQNHTAELIIPELPATHPPQNRTHHHHHH

SEQ ID NO: 327 - protein, 251 aa, Homo Sapiens
ELCDDDPPEIPHATFKAMAYKEGTMLNCECKRGFRRIKSGSLYMLCTGNSSHSSWDNQCQCTSSATRNTTKQVTPQPEEQKERKTTEMQSPMQPVDQASLPGHCREPPPWENEATERIYHFVVGQMVYYQCVQGYRALHRGPAESVCKMTHGKTRWTQPQLICTGEMETSQFPGEEKPQASPEGRPESETSCLVTTTDFQIQTEMAATMETSIFTTEYQVAVAGCVFLLISVLLLSGLTWQRRQRKSRRTI

SEQ ID NO: 328 - protein, 525 aa, Homo Sapiens
AVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRCNISWEISQASHYFERHLEFEARTLSPGHTWEEAPLLTLKQKQEWICLETLTPDTQYEFQVRVKPLQGEFTTWSPWSQPLAFRTKPAALGKDTIPWLGHLLVGLSGAFGFIILVYLLINCRNTGPWLKKVLKCNTPDPSKFFSQLSSEHGGDVQKWLSSPFPSSSFSPGGLAPEISPLEVLERDKVTQLLLQQDKVPEPASLSSNHSLTSCFTNQGYFFFHLPDALEIEACQVYFTYDPYSEEDPDEGVAGAPTGSSPQPLQPLSGEDDAYCTFPSRDDLLLFSPSLLGGPSPPSTAPGGSGAGEERMPPSLQERVPRDWDPQPLGPPTPGVPDLVDFQPPPELVLREAGEEVPDAGPREGVSFPWSRPPGQGEFRALNARLPLNTDAYLSLQELQGQDPTHLV

SEQ ID NO: 329 - protein, 347 aa, Homo Sapiens
LNTTILTPNGNEDTTADFFLTTMPTDSLSVSTLPLPEVQCFVFNVEYMNCTWNSSSEPQPTNLTLHYWYKNSDNDKVQKCSHYLFSEEITSGCQLQKKEIHLYQTFVVQLQDPREPRRQATQMLKLQNLVIPWAPENLTLHKLSESQLELNWNNRFLNHCLEHLVQYRTDWDHSWTEQSVDYRHKFSLPSVDGQKRYTFRVRSRFNPLCGSAQHWSEWSHPIHWGSNTSKENPFLFALEAVVISVGSMGLIISLLCVYFWLERTMPRIPTLKNLEDLVTEYHGNFSAWSGVSKGLAESLQPDYSERLCLVSEIPPKGGALGEGPGASPCNQHSPYWAPPCYTLKPET

SEQ ID NO: 330 - protein, 152 aa, Homo Sapiens
DCDIEGKDGKQYESVLMVSIDQLLDSMKEIGSNCLNNEFNFFKRHICDANKEGMFLFRAARKLRQFLKMNSTGDFDLHLLKVSEGTTILLNCTGQVKGRKPAALGEAQPTKSLEENKSLKEQKKLNDLCFLKRLLQEIKTCWNKILMGTKEH

SEQ ID NO: 331 - protein, 133 aa, Homo Sapiens
GIHVFILGCFSAGLPKTEANWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 332 - protein, 133 aa, Homo Sapiens [sequence omitted]

SEQ ID NO: 333 - protein, 127 aa, Homo Sapiens [sequence omitted]

SEQ ID NO: 334 - protein, 171 aa, Homo Sapiens
CDLPQNHGLLSRNTLVLLHQMRRISPFLCLKDRRDFRFPQEMVKGSQLQKAHVMSVLHEMLQQIFSLFHTERSSAAWNMTLLDQLHTELHQQLQHLETCLLQVVGEGESAGAISSPALTLRRYFQGIRVYLKEKKYSDCAWEVVRMEIMKSLFLSTNMQERLRSKDRDLGS

SEQ ID NO: 335 - protein, 177 aa, Homo Sapiens
GPQREEFPRDLSLISPLAQAVRSSSRTPSDKPVAHVVANPQAEGQLQWLNRRANALLANGVELRDNQLVVPSEGLYLIYSQVLFKGQGCPSTHVLLTHTISRIAVSYQTKVNLLSAIKSPCQRETPEGAEAKPWYEPIYLGGVFQLEKGDRLSAEINRPDYLDFAESGQVYFGIIAL

SEQ ID NO: 336 - protein, 197 aa, Homo Sapiens
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 337 - protein, 306 aa, Homo Sapiens
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 338 - protein, 103 aa, Homo Sapiens
TPVVRKGRCSCISTNQGTIHLQSLKDLKQFAPSPSCEKIEIIATLKNGVQTCLNPDSADVKELIKKWEKQVSQKKKQKNGKKHQKKKVLKVRKSQRSRQKKTT

SEQ ID NO: 339 - protein, 77 aa, Homo Sapiens
VPLSRTVRCTCISISNQPVNPRSLEKLEIIPASQFCPRVEIIATMKKKGEKRCLNPESKAIKNLLKAVSKERSKRSP

SEQ ID NO: 340 - protein, 330 aa, Homo Sapiens [sequence omitted]

SEQ ID NO: 341 - DNA, 996 bp, Homo Sapiens
gccagcaccaagggcccctctgtgttccctctggccccttccagcaagtccacctctggcggaacagccgctctgggctgcctcgtgaaggactacttccccgagcctgtgaccgtgtcctggaactctggcgctctgaccagcggagtgcacaccttccctgctgtgctgcagtcctccggcctgtactccctgtcctccgtcgtgaccgtgccttccagctctctgggcacccagacctacatctgcaacgtgaaccacaagccctccaacaccaaggtggacaagaaggtggaacccaagtcctgcgacaagacccacacctgtcccccttgtcctgcccctgaactgctgggcggaccttccgtgttcctgttccccccaaagcccaaggacaccctgatgatctcccggacccccgaagtgacctgcgtggtggtggatgtgtcccacgaggaccctgaagtgaagttcaattggtacgtggacggcgtggaagtgcacaacgccaagaccaagcctagagaggaacagtacaactccacctaccgggtggtgtccgtgctgaccgtgctgcaccaggattggctgaacggcaaagagtacaagtgcaaggtgtccaacaaggccctgcctgcccccatcgaaaagaccatctccaaggccaagggccagccccgggaaccccaggtgtacacactgccccctagcagggacgagctgaccaagaaccaggtgtccctgacctgtctcgtgaaaggcttctacccctccgatatcgccgtggaatgggagtccaacggccagcctgagaacaactacaagaccaccccccctgtgctggactccgacggctcattcttcctgtacagcaagctgacagtggacaagtcccggtggcagcagggcaacgtgttctcctgctccgtgatgcacgaggccctgcacaaccactacacccagaagtccctgtccctgagccccggcaagtgatga

SEQ ID NO: 342 - protein, 450 aa, Homo Sapiens
EVQLVESGGGLVQPGRSLRLSCAASGFTFDDYAMHWVRQAPGKGLEWVSGISWIRTGIGYADSVKGRFTISRDNAKNSLYLQMNSLRAEDTALYYCAKDMKGSGTYGGWFDTWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPELAGAPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 343 - protein, 8 aa, Homo Sapiens
GFTFSNYA

SEQ ID NO: 344 - protein, 8 aa, Homo Sapiens
ISFSGGTT

SEQ ID NO: 345 - protein, 14 aa, Homo Sapiens
AKDEAPAGATFFDS

SEQ ID NO: 346 - protein, 5 aa, Homo Sapiens
NYAMS

SEQ ID NO: 347 - protein, 17 aa, Homo Sapiens
AISFSGGTTYYADSVKG

SEQ ID NO: 348 - protein, 12 aa, Homo Sapiens
DEAPAGATFFDS

SEQ ID NO: 349 - protein, 121 aa, Homo Sapiens
EVQLAESGGGLVQPGGSLRLSCAASGFTFSNYAMSWVRQTPGKGLEWVSAISFSGGTTYYADSVKGRFTISRDNSKNTLYLHMNSLRADDTAVYYCAKDEAPAGATFFDSWGQGTLVTVSS

SEQ ID NO: 350 - DNA, 364 bp, Homo Sapiens
gaagtgcaactggcggagtctgggggaggcttggtacagccgggggggtccctgagactctcctgtgcagcctctggattcacctttagcaactatgccatgagttgggtccgccagactccaggaaaggggctggagtgggtctcagctattagttttagtggtggtactacatactacgctgactccgtgaagggccggttcaccatctccagagacaattccaagaacacgctgtatttgcacatgaacagcctgagagccgatgacacggccgtatattactgtgcgaaagatgaggcaccagctggcgcaaccttctttgactcctggggccagggaacgctggtcaccgtctcctcag

SEQ ID NO: 351 - protein, 448 aa, Homo Sapiens
EVQLAESGGGLVQPGGSLRLSCAASGFTFSNYAMSWVRQTPGKGLEWVSAISFSGGTTYYADSVKGRFTISRDNSKNTLYLHMNSLRADDTAVYYCAKDEAPAGATFFDSWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 352 - DNA, 1344 bp, Homo Sapiens
gaagtgcaactggcggagtctgggggaggcttggtacagccgggggggtccctgagactctcctgtgcagcctctggattcacctttagcaactatgccatgagttgggtccgccagactccaggaaaggggctggagtgggtctcagctattagttttagtggtggtactacatactacgctgactccgtgaagggccggttcaccatctccagagacaattccaagaacacgctgtatttgcacatgaacagcctgagagccgatgacacggccgtatattactgtgcgaaagatgaggcaccagctggcgcaaccttctttgactcctggggccagggaacgctggtcaccgtctcctcagccagcaccaagggcccttccgtgttccccctggccccttgcagcaggagcacctccgaatccacagctgccctgggctgtctggtgaaggactactttcccgagcccgtgaccgtgagctggaacagcggcgctctgacatccggcgtccacacctttcctgccgtcctgcagtcctccggcctctactccctgtcctccgtggtgaccgtgcctagctcctccctcggcaccaagacctacacctgtaacgtggaccacaaaccctccaacaccaaggtggacaaacgggtcgagagcaagtacggccctccctgccctccttgtcctgcccccgagttcgaaggcggacccagcgtgttcctgttccctcctaagcccaaggacaccctcatgatcagccggacacccgaggtgacctgcgtggtggtggatgtgagccaggaggaccctgaggtccagttcaactggtatgtggatggcgtggaggtgcacaacgccaagacaaagccccgggaagagcagttcaactccacctacagggtggtcagcgtgctgaccgtgctgcatcaggactggctgaacggcaaggagtacaagtgcaaggtcagcaataagggactgcccagcagcatcgagaagaccatctccaaggctaaaggccagccccgggaacctcaggtgtacaccctgcctcccagccaggaggagatgaccaagaaccaggtgagcctgacctgcctggtgaagggattctacccttccgacatcgccgtggagtgggagtccaacggccagcccgagaacaattataagaccacccctcccgtcctcgacagcgacggatccttctttctgtactccaggctgaccgtggataagtccaggtggcaggaaggcaacgtgttcagctgctccgtgatgcacgaggccctgcacaatcactacacccagaagtccctgagcctgtccctgggaaag

SEQ ID NO: 353 - protein, 6 aa, Homo Sapiens
QGIRRW

SEQ ID NO: 354 - protein, 3 aa, Homo Sapiens
GAS

SEQ ID NO: 355 - protein, 9 aa, Homo Sapiens
QQANSFPIT

SEQ ID NO: 356 - protein, 11 aa, Homo Sapiens
RASQGIRRWLA

SEQ ID NO: 357 - protein, 7 aa, Homo Sapiens
GASSLQS

SEQ ID NO: 358 - protein, 9 aa, Homo Sapiens
QQANSFPIT

SEQ ID NO: 359 - protein, 107 aa, Homo Sapiens
DIQMTQSPSSVSASVGDRVTITCRASQGIRRWLAWYQQKPGKAPKLLISGASSLQSGVPSRFSGSGSGTDFTLIITSLQPEDFATYYCQQANSFPITFGQGTRLEIK

SEQ ID NO: 360 - DNA, 322 bp, Homo Sapiens
gacatccagatgacccagtctccatcttccgtgtctgcatctgtaggagacagagtcaccatcacttgtcgggcgagtcagggtattaggaggtggttagcctggtatcagcagaaaccagggaaagcccctaaactcctgatctctggtgcatccagtttgcaaagtggggtcccatcaaggttcagcggcagtggatctgggacagatttcactctcatcattaccagtctgcagcctgaagattttgcaacttactattgtcaacaggctaacagtttcccgatcaccttcggccaagggacacgactggagatcaaac

SEQ ID NO: 361 - protein, 214 aa, Homo Sapiens
DIQMTQSPSSVSASVGDRVTITCRASQGIRRWLAWYQQKPGKAPKLLISGASSLQSGVPSRFSGSGSGTDFTLIITSLQPEDFATYYCQQANSFPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 362 - DNA, 642 bp, Homo Sapiens
gacatccagatgacccagtctccatcttccgtgtctgcatctgtaggagacagagtcaccatcacttgtcgggcgagtcagggtattaggaggtggttagcctggtatcagcagaaaccagggaaagcccctaaactcctgatctctggtgcatccagtttgcaaagtggggtcccatcaaggttcagcggcagtggatctgggacagatttcactctcatcattaccagtctgcagcctgaagattttgcaacttactattgtcaacaggctaacagtttcccgatcaccttcggccaagggacacgactggagatcaaacgtacggtggccgctccctccgtgttcatcttcccaccttccgacgagcagctgaagtccggcaccgcttctgtcgtgtgcctgctgaacaacttctacccccgcgaggccaaggtgcagtggaaggtggacaacgccctgcagtccggcaactcccaggaatccgtgaccgagcaggactccaaggacagcacctactccctgtcctccaccctgaccctgtccaaggccgactacgagaagcacaaggtgtacgcctgcgaagtgacccaccagggcctgtctagccccgtgaccaagtctttcaaccggggcgagtgt

SEQ ID NO: 363 - protein, 8 aa, Homo Sapiens
GYTFSTFG

SEQ ID NO: 364 - protein, 8 aa, Homo Sapiens
ISAYNGDT

SEQ ID NO: 365 - protein, 14 aa, Homo Sapiens
ARSSGHYYYYGMDV

SEQ ID NO: 366 - protein, 121 aa, Homo Sapiens
QVQVVQSGAEVKKPGASVKVSCKASGYTFSTFGITWVRQAPGQGLEWMGWISAYNGDTNYAQNLQGRVIMTTDTSTSTAYMELRSLRSDDTAVYYCARSSGHYYYYGMDVWGQGTTVTVSS

SEQ ID NO: 367 - DNA, 363 bp, Homo Sapiens
caggttcaggtggtgcagtctggagctgaggtgaagaagcctggggcctcagtgaaggtctcctgcaaggcttctggttacaccttttccacctttggtatcacctgggtgcgacaggcccctggacaagggcttgaatggatgggatggatcagcgcttacaatggtgacacaaactatgcacagaatctccagggcagagtcatcatgaccacagacacatccacgagcacagcctacatggagctgaggagcctgagatctgacgacacggccgtttattactgtgcgaggagcagtggccactactactactacggtatggacgtctggggccaagggaccacggtcaccgtctcctca

SEQ ID NO: 368 - protein, 451 aa, Homo Sapiens
QVQVVQSGAEVKKPGASVKVSCKASGYTFSTFGITWVRQAPGQGLEWMGWISAYNGDTNYAQNLQGRVIMTTDTSTSTAYMELRSLRSDDTAVYYCARSSGHYYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 369 - DNA, 1359 bp, Homo Sapiens
caggttcaggtggtgcagtctggagctgaggtgaagaagcctggggcctcagtgaaggtctcctgcaaggcttctggttacaccttttccacctttggtatcacctgggtgcgacaggcccctggacaagggcttgaatggatgggatggatcagcgcttacaatggtgacacaaactatgcacagaatctccagggcagagtcatcatgaccacagacacatccacgagcacagcctacatggagctgaggagcctgagatctgacgacacggccgtttattactgtgcgaggagcagtggccactactactactacggtatggacgtctggggccaagggaccacggtcaccgtctcctcagccagcaccaagggcccctctgtgttccctctggccccttccagcaagtccacctctggcggaacagccgctctgggctgcctcgtgaaggactacttccccgagcctgtgaccgtgtcctggaactctggcgctctgaccagcggagtgcacaccttccctgctgtgctgcagtcctccggcctgtactccctgtcctccgtcgtgaccgtgccttccagctctctgggcacccagacctacatctgcaacgtgaaccacaagccctccaacaccaaggtggacaagaaggtggaacccaagtcctgcgacaagacccacacctgtcccccttgtcctgcccctgaactgctgggcggaccttccgtgttcctgttccccccaaagcccaaggacaccctgatgatctcccggacccccgaagtgacctgcgtggtggtggatgtgtcccacgaggaccctgaagtgaagttcaattggtacgtggacggcgtggaagtgcacaacgccaagaccaagcctagagaggaacagtacaactccacctaccgggtggtgtccgtgctgaccgtgctgcaccaggattggctgaacggcaaagagtacaagtgcaaggtgtccaacaaggccctgcctgcccccatcgaaaagaccatctccaaggccaagggccagccccgggaaccccaggtgtacacactgccccctagcagggacgagctgaccaagaaccaggtgtccctgacctgtctcgtgaaaggcttctacccctccgatatcgccgtggaatgggagtccaacggccagcctgagaacaactacaagaccaccccccctgtgctggactccgacggctcattcttcctgtacagcaagctgacagtggacaagtcccggtggcagcagggcaacgtgttctcctgctccgtgatgcacgaggccctgcacaaccactacacccagaagtccctgtccctgagccccggcaagtgatga

SEQ ID NO: 370 - protein, 11 aa, Homo Sapiens
QSLLHSNEYNY

SEQ ID NO: 371 - protein, 3 aa, Homo Sapiens
LGS

SEQ ID NO: 372 - protein, 9 aa, Homo Sapiens
MQSLQTPLT

SEQ ID NO: 373 - protein, 112 aa, Homo Sapiens
DIVMTQSPLSLPVTPGEPASISCRSSQSLLHSNEYNYLDWYLQKPGQSPQLLIFLGSNRASGVPDRFSGSGSGTDFTLKITRVEAEDVGIYYCMQSLQTPLTFGGGTKVEIK

SEQ ID NO: 374 - DNA, 336 bp, Homo Sapiens
gatattgtgatgactcagtctccactctccctgcccgtcacccctggagagccggcctccatctcctgcaggtctagtcagagcctcctgcatagtaatgaatacaactatttggattggtacctgcagaagccagggcagtctccacagctcctgatctttttgggttctaatcgggcctccggggtccctgacaggttcagtggcagtggatcaggcacagattttacactgaaaatcaccagagtggaggctgaggatgttggaatttattactgcatgcaatctctacaaactccgctcactttcggcggagggaccaaggtggagatcaaa

SEQ ID NO: 375 - protein, 219 aa, Homo Sapiens
DIVMTQSPLSLPVTPGEPASISCRSSQSLLHSNEYNYLDWYLQKPGQSPQLLIFLGSNRASGVPDRFSGSGSGTDFTLKITRVEAEDVGIYYCMQSLQTPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 376 - DNA, 657 bp, Homo Sapiens
gatattgtgatgactcagtctccactctccctgcccgtcacccctggagagccggcctccatctcctgcaggtctagtcagagcctcctgcatagtaatgaatacaactatttggattggtacctgcagaagccagggcagtctccacagctcctgatctttttgggttctaatcgggcctccggggtccctgacaggttcagtggcagtggatcaggcacagattttacactgaaaatcaccagagtggaggctgaggatgttggaatttattactgcatgcaatctctacaaactccgctcactttcggcggagggaccaaggtggagatcaaacgtacggtggccgctccctccgtgttcatcttcccaccttccgacgagcagctgaagtccggcaccgcttctgtcgtgtgcctgctgaacaacttctacccccgcgaggccaaggtgcagtggaaggtggacaacgccctgcagtccggcaactcccaggaatccgtgaccgagcaggactccaaggacagcacctactccctgtcctccaccctgaccctgtccaaggccgactacgagaagcacaaggtgtacgcctgcgaagtgacccaccagggcctgtctagccccgtgaccaagtctttcaaccggggcgagtgt

SEQ ID NO: 377 - protein, 8 aa, Homo Sapiens
GYTFTSYG

SEQ ID NO: 378 - protein, 8 aa, Homo Sapiens
ISAYNGNT

SEQ ID NO: 379 - protein, 17 aa, Homo Sapiens
ARSTYFYGSGTLYGMDV

SEQ ID NO: 380 - protein, 124 aa, Homo Sapiens
QVQLVQSGGEVKKPGASVKVSCKASGYTFTSYGFSWVRQAPGQGLEWMGWISAYNGNTNYAQKLQGRVTMTTDTSTSTAYMELRSLRSDDTAVYYCARSTYFYGSGTLYGMDVWGQGTTVTVSS

SEQ ID NO: 381 - DNA, 372 bp, Homo Sapiens
caggttcaactggtgcagtctggaggtgaggtgaagaagcctggggcctcagtgaaggtctcctgcaaggcttctggttacacctttaccagctatggtttcagctgggtgcgacaggcccctggacaaggactagagtggatgggatggatcagcgcttacaatggtaacacaaactatgcacagaagctccagggcagagtcaccatgaccacagacacatccacgagcacagcctacatggagctgaggagcttgagatctgacgacacggccgtgtattactgtgcgagatctacgtatttctatggttcggggaccctctacggtatggacgtctggggccaagggaccacggtcaccgtctcctca

SEQ ID NO: 382 - protein, 454 aa, Homo Sapiens
QVQLVQSGGEVKKPGASVKVSCKASGYTFTSYGFSWVRQAPGQGLEWMGWISAYNGNTNYAQKLQGRVTMTTDTSTSTAYMELRSLRSDDTAVYYCARSTYFYGSGTLYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 383 - DNA, 1368 bp, Homo Sapiens
caggttcaactggtgcagtctggaggtgaggtgaagaagcctggggcctcagtgaaggtctcctgcaaggcttctggttacacctttaccagctatggtttcagctgggtgcgacaggcccctggacaaggactagagtggatgggatggatcagcgcttacaatggtaacacaaactatgcacagaagctccagggcagagtcaccatgaccacagacacatccacgagcacagcctacatggagctgaggagcttgagatctgacgacacggccgtgtattactgtgcgagatctacgtatttctatggttcggggaccctctacggtatggacgtctggggccaagggaccacggtcaccgtctcctcagccagcaccaagggcccctctgtgttccctctggccccttccagcaagtccacctctggcggaacagccgctctgggctgcctcgtgaaggactacttccccgagcctgtgaccgtgtcctggaactctggcgctctgaccagcggagtgcacaccttccctgctgtgctgcagtcctccggcctgtactccctgtcctccgtcgtgaccgtgccttccagctctctgggcacccagacctacatctgcaacgtgaaccacaagccctccaacaccaaggtggacaagaaggtggaacccaagtcctgcgacaagacccacacctgtcccccttgtcctgcccctgaactgctgggcggaccttccgtgttcctgttccccccaaagcccaaggacaccctgatgatctcccggacccccgaagtgacctgcgtggtggtggatgtgtcccacgaggaccctgaagtgaagttcaattggtacgtggacggcgtggaagtgcacaacgccaagaccaagcctagagaggaacagtacaactccacctaccgggtggtgtccgtgctgaccgtgctgcaccaggattggctgaacggcaaagagtacaagtgcaaggtgtccaacaaggccctgcctgcccccatcgaaaagaccatctccaaggccaagggccagccccgggaaccccaggtgtacacactgccccctagcagggacgagctgaccaagaaccaggtgtccctgacctgtctcgtgaaaggcttctacccctccgatatcgccgtggaatgggagtccaacggccagcctgagaacaactacaagaccaccccccctgtgctggactccgacggctcattcttcctgtacagcaagctgacagtggacaagtcccggtggcagcagggcaacgtgttctcctgctccgtgatgcacgaggccctgcacaaccactacacccagaagtccctgtccctgagccccggcaagtgatga

SEQ ID NO: 384 - protein, 11 aa, Homo Sapiens
QSLLHSDGYNY

SEQ ID NO: 385 - protein, 3 aa, Homo Sapiens
LGS

SEQ ID NO: 386 - protein, 9 aa, Homo Sapiens
MQALQTPLS

SEQ ID NO: 387 - protein, 112 aa, Homo Sapiens
DIVMTQSPLSLPVTPGEPASISCRSSQSLLHSDGYNYLDWYLQKPGQSPQLLIYLGSTRASGFPDRFSGSGSGTDFTLKISRVEAEDVGVYYCMQALQTPLSFGQGTKLEIK

SEQ ID NO: 388 - DNA, 336 bp, Homo Sapiens
gatattgtgatgactcagtctccactctccctgcccgtcacccctggagagccggcctccatctcctgcaggtctagtcagagcctcctgcatagtgatggatacaactgtttggattggtacctgcagaagccagggcagtctccacagctcctgatctatttgggttctactcgggcctccgggttccctgacaggttcagtggcagtggatcaggcacagattttacactgaaaatcagcagagtggaggctgaggatgttggggtttattactgcatgcaagctctacaaactccgtgcagttttggccaggggaccaagctggagatcaaa

SEQ ID NO: 389 - protein, 219 aa, Homo Sapiens
DIVMTQSPLSLPVTPGEPASISCRSSQSLLHSDGYNYLDWYLQKPGQSPQLLIYLGSTRASGFPDRFSGSGSGTDFTLKISRVEAEDVGVYYCMQALQTPLSFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 390 - DNA, 657 bp, Homo Sapiens
gatattgtgatgactcagtctccactctccctgcccgtcacccctggagagccggcctccatctcctgcaggtctagtcagagcctcctgcatagtgatggatacaactgtttggattggtacctgcagaagccagggcagtctccacagctcctgatctatttgggttctactcgggcctccgggttccctgacaggttcagtggcagtggatcaggcacagattttacactgaaaatcagcagagtggaggctgaggatgttggggtttattactgcatgcaagctctacaaactccgtgcagttttggccaggggaccaagctggagatcaaacgtacggtggccgctccctccgtgttcatcttcccaccttccgacgagcagctgaagtccggcaccgcttctgtcgtgtgcctgctgaacaacttctacccccgcgaggccaaggtgcagtggaaggtggacaacgccctgcagtccggcaactcccaggaatccgtgaccgagcaggactccaaggacagcacctactccctgtcctccaccctgaccctgtccaaggccgactacgagaagcacaaggtgtacgcctgcgaagtgacccaccagggcctgtctagccccgtgaccaagtctttcaaccggggcgagtgt

SEQ ID NO: 391 - protein, 8 aa, Homo Sapiens
GYTFTSYG

SEQ ID NO: 392 - protein, 8 aa, Homo Sapiens
ISAYNGNT

SEQ ID NO: 393 - protein, 17 aa, Homo Sapiens
ARSTYFYGSGTLYGMDV

SEQ ID NO: 394 - protein, 124 aa, Homo Sapiens; identical to SEQ ID NO: 380

SEQ ID NO: 395 - DNA, 372 bp, Homo Sapiens; identical to SEQ ID NO: 381

SEQ ID NO: 396 - protein, 454 aa, Homo Sapiens; identical to SEQ ID NO: 382

SEQ ID NO: 397 - DNA, 1368 bp, Homo Sapiens; identical to SEQ ID NO: 383

SEQ ID NO: 398 - protein, 11 aa, Homo Sapiens
QSLLHSDGYNC

SEQ ID NO: 399 - protein, 3 aa, Homo Sapiens
LGS

SEQ ID NO: 400 - protein, 9 aa, Homo Sapiens
MQALQTPCS

SEQ ID NO: 401 - protein, 112 aa, Homo Sapiens
DIVMTQSPLSLPVTPGEPASISCRSSQSLLHSDGYNCLDWYLQKPGQSPQLLIYLGSTRASGFPDRFSGSGSGTDFTLKISRVEAEDVGVYYCMQALQTPCSFGQGTKLEIK

SEQ ID NO: 402 - DNA, 336 bp, Homo Sapiens; identical to SEQ ID NO: 388

SEQ ID NO: 403 - protein, 219 aa, Homo Sapiens
DIVMTQSPLSLPVTPGEPASISCRSSQSLLHSDGYNCLDWYLQKPGQSPQLLIYLGSTRASGFPDRFSGSGSGTDFTLKISRVEAEDVGVYYCMQALQTPCSFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 404 - DNA, 657 bp, Homo Sapiens; identical to SEQ ID NO: 390

SEQ ID NO: 405 - protein, 8 aa, Homo Sapiens
GVTFDDYG

SEQ ID NO: 406 - protein, 8 aa, Homo Sapiens
INWNGGDT

SEQ ID NO: 407 - protein, 17 aa, Homo Sapiens
ARDFYGSGSYYHVPFDY

SEQ ID NO: 408 - protein, 124 aa, Homo Sapiens
EVQLVESGGGVVRPGGSLRLSCVASGVTFDDYGMSWVRQAPGKGLEWVSGINWNGGDTDYSDSVKGRFTISRDNAKNSLYLQMNSLRAEDTALYYCARDFYGSGSYYHVPFDYWGQGILVTVSS

SEQ ID NO: 409 - DNA, 372 bp, Homo Sapiens
gaggtgcagctggtggagtctgggggaggtgtggtacggcctggggggtccctgagactctcctgtgtagcctctggagtcacctttgatgattatggcatgagctgggtccgccaagctccagggaaggggctggartgggtctctggtattaattggaatggtggcgacacagattattcagactctgtgaagggccgattcaccatctccagagacaacgccaagaactccctgtatctacaaatgaatagtctgagagccgaggacacggccttgtattactgtgcgagggatttctatggttcggggagttattatcacgttccttttgactactggggccagggaatcctggtcaccgtctcctca

SEQ ID NO: 410 - protein, 454 aa, Homo Sapiens
EVQLVESGGGVVRPGGSLRLSCVASGVTFDDYGMSWVRQAPGKGLEWVSGINWNGGDTDYSDSVKGRFTISRDNAKNSLYLQMNSLRAEDTALYYCARDFYGSGSYYHVPFDYWGQGILVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 411 - DNA, 1368 bp, Homo Sapiens
gaggtgcagctggtggagtctgggggaggtgtggtacggcctggggggtccctgagactctcctgtgtagcctctggagtcacctttgatgattatggcatgagctgggtccgccaagctccagggaaggggctggartgggtctctggtattaattggaatggtggcgacacagattattcagactctgtgaagggccgattcaccatctccagagacaacgccaagaactccctgtatctacaaatgaatagtctgagagccgaggacacggccttgtattactgtgcgagggatttctatggttcggggagttattatcacgttccttttgactactggggccagggaatcctggtcaccgtctcctcagccagcaccaagggcccctctgtgttccctctggccccttccagcaagtccacctctggcggaacagccgctctgggctgcctcgtgaaggactacttccccgagcctgtgaccgtgtcctggaactctggcgctctgaccagcggagtgcacaccttccctgctgtgctgcagtcctccggcctgtactccctgtcctccgtcgtgaccgtgccttccagctctctgggcacccagacctacatctgcaacgtgaaccacaagccctccaacaccaaggtggacaagaaggtggaacccaagtcctgcgacaagacccacacctgtcccccttgtcctgcccctgaactgctgggcggaccttccgtgttcctgttccccccaaagcccaaggacaccctgatgatctcccggacccccgaagtgacctgcgtggtggtggatgtgtcccacgaggaccctgaagtgaagttcaattggtacgtggacggcgtggaagtgcacaacgccaagaccaagcctagagaggaacagtacaactccacctaccgggtggtgtccgtgctgaccgtgctgcaccaggattggctgaacggcaaagagtacaagtgcaaggtgtccaacaaggccctgcctgcccccatcgaaaagaccatctccaaggccaagggccagccccgggaaccccaggtgtacacactgccccctagcagggacgagctgaccaagaaccaggtgtccctgacctgtctcgtgaaaggcttctacccctccgatatcgccgtggaatgggagtccaacggccagcctgagaacaactacaagaccaccccccctgtgctggactccgacggctcattcttcctgtacagcaagctgacagtggacaagtcccggtggcagcagggcaacgtgttctcctgctccgtgatgcacgaggccctgcacaaccactacacccagaagtccctgtccctgagccccggcaagtgatga

SEQ ID NO: 412 - protein, 7 aa, Homo Sapiens
QSVSRSY

SEQ ID NO: 413 - protein, 3 aa, Homo Sapiens
GAS

SEQ ID NO: 414 - protein, 9 aa, Homo Sapiens
HQYDMSPFT

SEQ ID NO: 415 - protein, 108 aa, Homo Sapiens
EIVLTQSPGTLSLSPGERATLSCRASQSVSRSYLAWYQQKRGQAPRLLIYGASSRATGIPDRFSGDGSGTDFTLSISRLEPEDFAVYYCHQYDMSPFTFGPGTKVDIK

SEQ ID NO: 416 - DNA, 324 bp, Homo Sapiens
gaaattgtgttgacgcagtctccagggaccctgtctttgtctccaggggaaagagccaccctctcctgcagggccagtcagagtgttagcagaagctacttagcctggtaccagcagaaacgtggccaggctcccaggctcctcatctatggtgcatccagcagggccactggcatcccagacaggttcagtggcgatgggtctgggacagacttcactctctccatcagcagactggagcctgaagattttgcagtgtattactgtcaccagtatgatatgtcaccattcactttcggccctgggaccaaagtggatatcaaa

SEQ ID NO: 417 - protein, 215 aa, Homo Sapiens
EIVLTQSPGTLSLSPGERATLSCRASQSVSRSYLAWYQQKRGQAPRLLIYGASSRATGIPDRFSGDGSGTDFTLSISRLEPEDFAVYYCHQYDMSPFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 418 - DNA, 645 bp, Homo Sapiens
gaaattgtgttgacgcagtctccagggaccctgtctttgtctccaggggaaagagccaccctctcctgcagggccagtcagagtgttagcagaagctacttagcctggtaccagcagaaacgtggccaggctcccaggctcctcatctatggtgcatccagcagggccactggcatcccagacaggttcagtggcgatgggtctgggacagacttcactctctccatcagcagactggagcctgaagattttgcagtgtattactgtcaccagtatgatatgtcaccattcactttcggccctgggaccaaagtggatatcaaacgtacggtggccgctccctccgtgttcatcttcccaccttccgacgagcagctgaagtccggcaccgcttctgtcgtgtgcctgctgaacaacttctacccccgcgaggccaaggtgcagtggaaggtggacaacgccctgcagtccggcaactcccaggaatccgtgaccgagcaggactccaaggacagcacctactccctgtcctccaccctgaccctgtccaaggccgactacgagaagcacaaggtgtacgcctgcgaagtgacccaccagggcctgtctagccccgtgaccaagtctttcaaccggggcgagtgt

SEQ ID NO: 419 - protein, 8 aa, Homo Sapiens
GLTFDDYG

SEQ ID NO: 420 - protein, 8 aa, Homo Sapiens
INWNGDNT

SEQ ID NO: 421 - protein, 17 aa, Homo Sapiens
ARDYYGSGSYYNVPFDY

SEQ ID NO: 422 - protein, 124 aa, Homo Sapiens
EVQLVESGGGVVRPGGSLRLSCAASGLTFDDYGMSWVRQVPGKGLEWVSGINWNGDNTDYADSVKGRFTISRDNAKNSLYLQMNSLRAEDTALYYCARDYYGSGSYYNVPFDYWGQGTLVTVSS

SEQ ID NO: 423 - DNA, 372 bp, Homo Sapiens
gaggtgcagctggtggagtctgggggaggtgtggtacggcctggggggtccctgagactctcctgtgcagcctctggactcacctttgatgattatggcatgagctgggtccgccaagttccagggaaggggctggagtgggtctctggtattaattggaatggtgataacacagattatgcagactctgtgaagggccgattcaccatctccagagacaacgccaagaactccctgtatctgcaaatgaacagtctgagagccgaggacacggccttgtattactgtgcgagggattactatggttcggggagttattataacgttccttttgactactggggccagggaaccctggtcaccgtctcctca

SEQ ID NO: 424 - protein, 454 aa, Homo Sapiens
EVQLVESGGGVVRPGGSLRLSCAASGLTFDDYGMSWVRQVPGKGLEWVSGINWNGDNTDYADSVKGRFTISRDNAKNSLYLQMNSLRAEDTALYYCARDYYGSGSYYNVPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 425 - DNA, 1368 bp, Homo Sapiens
gaggtgcagctggtggagtctgggggaggtgtggtacggcctggggggtccctgagactctcctgtgcagcctctggactcacctttgatgattatggcatgagctgggtccgccaagttccagggaaggggctggagtgggtctctggtattaattggaatggtgataacacagattatgcagactctgtgaagggccgattcaccatctccagagacaacgccaagaactccctgtatctgcaaatgaacagtctgagagccgaggacacggccttgtattactgtgcgagggattactatggttcggggagttattataacgttccttttgactactggggccagggaaccctggtcaccgtctcctcagccagcaccaagggcccctctgtgttccctctggccccttccagcaagtccacctctggcggaacagccgctctgggctgcctcgtgaaggactacttccccgagcctgtgaccgtgtcctggaactctggcgctctgaccagcggagtgcacaccttccctgctgtgctgcagtcctccggcctgtactccctgtcctccgtcgtgaccgtgccttccagctctctgggcacccagacctacatctgcaacgtgaaccacaagccctccaacaccaaggtggacaagaaggtggaacccaagtcctgcgacaagacccacacctgtcccccttgtcctgcccctgaactgctgggcggaccttccgtgttcctgttccccccaaagcccaaggacaccctgatgatctcccggacccccgaagtgacctgcgtggtggtggatgtgtcccacgaggaccctgaagtgaagttcaattggtacgtggacggcgtggaagtgcacaacgccaagaccaagcctagagaggaacagtacaactccacctaccgggtggtgtccgtgctgaccgtgctgcaccaggattggctgaacggcaaagagtacaagtgcaaggtgtccaacaaggccctgcctgcccccatcgaaaagaccatctccaaggccaagggccagccccgggaaccccaggtgtacacactgccccctagcagggacgagctgaccaagaaccaggtgtccctgacctgtctcgtgaaaggcttctacccctccgatatcgccgtggaatgggagtccaacggccagcctgagaacaactacaagaccaccccccctgtgctggactccgacggctcattcttcctgtacagcaagctgacagtggacaagtcccggtggcagcagggcaacgtgttctcctgctccgtgatgcacgaggccctgcacaaccactacacccagaagtccctgtccctgagccccggcaagtgatga

SEQ ID NO: 426 - protein, 7 aa, Homo Sapiens
QSVSSSY

SEQ ID NO: 427 - protein, 3 aa, Homo Sapiens
GAS

SEQ ID NO: 428 - protein, 8 aa, Homo Sapiens
QQYGSSPF

SEQ ID NO: 429 - protein, 107 aa, Homo Sapiens
EIVLTQSPGTLSLSPGERATLSCRASQSVSSSYLAWYQQKPGQAPRLLIYGASSRATGIPDRFSGSGSGTDFTLTIRRLEPEDFAVYYCQQYGSSPFFGPGTKVDIK

SEQ ID NO: 430 - DNA, 321 bp, Homo Sapiens
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatatatggtgcatccagcagggccactggcatcccagacaggttcagtggcagtgggtctgggacagacttcactctcaccatcagaagactggagcctgaagattttgcagtgtattactgtcagcagtatggtagttcaccattcttcggccctgggaccaaagtggatatcaaa

SEQ ID NO: 431 - DNA, 323 bp, Homo Sapiens
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatatatggtgcatccagcagggccactggcatcccagacaggttcagtggcagtgggtctgggacagacttcactctcaccatcagaagactggagcctgaagattttgcagtgtattactgtcagcagtatggtagttcaccattcacttcggccctgggaccaaagtggatatcaaa

SEQ ID NO: 432 - protein, 214 aa, Homo Sapiens
EIVLTQSPGTLSLSPGERATLSCRASQSVSSSYLAWYQQKPGQAPRLLIYGASSRATGIPDRFSGSGSGTDFTLTIRRLEPEDFAVYYCQQYGSSPFFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 433 - DNA, 642 bp, Homo Sapiens
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatatatggtgcatccagcagggccactggcatcccagacaggttcagtggcagtgggtctgggacagacttcactctcaccatcagaagactggagcctgaagattttgcagtgtattactgtcagcagtatggtagttcaccattcttcggccctgggaccaaagtggatatcaaacgtacggtggccgctccctccgtgttcatcttcccaccttccgacgagcagctgaagtccggcaccgcttctgtcgtgtgcctgctgaacaacttctacccccgcgaggccaaggtgcagtggaaggtggacaacgccctgcagtccggcaactcccaggaatccgtgaccgagcaggactccaaggacagcacctactccctgtcctccaccctgaccctgtccaaggccgactacgagaagcacaaggtgtacgcctgcgaagtgacccaccagggcctgtctagccccgtgaccaagtctttcaaccggggcgagtgt

SEQ ID NO: 434 - DNA, 644 bp, Homo Sapiens
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatatatggtgcatccagcagggccactggcatcccagacaggttcagtggcagtgggtctgggacagacttcactctcaccatcagaagactggagcctgaagattttgcagtgtattactgtcagcagtatggtagttcaccattcacttcggccctgggaccaaagtggatatcaaacgtacggtggccgctccctccgtgttcatcttcccaccttccgacgagcagctgaagtccggcaccgcttctgtcgtgtgcctgctgaacaacttctacccccgcgaggccaaggtgcagtggaaggtggacaacgccctgcagtccggcaactcccaggaatccgtgaccgagcaggactccaaggacagcacctactccctgtcctccaccctgaccctgtccaaggccgactacgagaagcacaaggtgtacgcctgcgaagtgacccaccagggcctgtctagccccgtgaccaagtctttcaaccggggcgagtgt

SEQ ID NO: 435 - protein, 8 aa, Homo Sapiens
GYTFNSYG

SEQ ID NO: 436 - protein, 8 aa, Homo Sapiens
ISVHNGNT

SEQ ID NO: 437 - protein, 17 aa, Homo Sapiens
ARAGYDILTDFSDAFDI

SEQ ID NO: 438 - protein, 124 aa, Homo Sapiens
QVQLVQSGAEVKKPGASVKVSCKASGYTFNSYGIIWVRQAPGQGLEWMGWISVHNGNTNCAQKLQGRVTMTTDTSTSTAYMELRSLRTDDTAVYYCARAGYDILTDFSDAFDIWGHGTMVTVSS

SEQ ID NO: 439 - DNA, 372 bp, Homo Sapiens
caggttcagttggtgcagtctggagctgaggtgaagaagcctggggcctcagtgaaggtctcctgcaaggcttctggttacacctttaatagttatggtatcatctgggtgcgacaggcccctggacaagggcttgagtggatgggatggatcagcgttcacaatggtaacacaaactgtgcacagaagctccagggtagagtcaccatgaccacagacacatccacgagcacagcctacatggagctgaggagcctgagaactgacgacacggccgtgtattactgtgcgagagcgggttacgatattttgactgatttttccgatgcttttgatatctggggccacgggacaatggtcaccgtctcttca

SEQ ID NO: 440 - protein, 454 aa, Homo Sapiens
QVQLVQSGAEVKKPGASVKVSCKASGYTFNSYGIIWVRQAPGQGLEWMGWISVHNGNTNCAQKLQGRVTMTTDTSTSTAYMELRSLRTDDTAVYYCARAGYDILTDFSDAFDIWGHGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 441 - DNA, 1368 bp, Homo Sapiens
caggttcagttggtgcagtctggagctgaggtgaagaagcctggggcctcagtgaaggtctcctgcaaggcttctggttacacctttaatagttatggtatcatctgggtgcgacaggcccctggacaagggcttgagtggatgggatggatcagcgttcacaatggtaacacaaactgtgcacagaagctccagggtagagtcaccatgaccacagacacatccacgagcacagcctacatggagctgaggagcctgagaactgacgacacggccgtgtattactgtgcgagagcgggttacgatattttgactgatttttccgatgcttttgatatctggggccacgggacaatggtcaccgtctcttcagccagcaccaagggcccctctgtgttccctctggccccttccagcaagtccacctctggcggaacagccgctctgggctgcctcgtgaaggactacttccccgagcctgtgaccgtgtcctggaactctggcgctctgaccagcggagtgcacaccttccctgctgtgctgcagtcctccggcctgtactccctgtcctccgtcgtgaccgtgccttccagctctctgggcacccagacctacatctgcaacgtgaaccacaagccctccaacaccaaggtggacaagaaggtggaacccaagtcctgcgacaagacccacacctgtcccccttgtcctgcccctgaactgctgggcggaccttccgtgttcctgttccccccaaagcccaaggacaccctgatgatctcccggacccccgaagtgacctgcgtggtggtggatgtgtcccacgaggaccctgaagtgaagttcaattggtacgtggacggcgtggaagtgcacaacgccaagaccaagcctagagaggaacagtacaactccacctaccgggtggtgtccgtgctgaccgtgctgcaccaggattggctgaacggcaaagagtacaagtgcaaggtgtccaacaaggccctgcctgcccccatcgaaaagaccatctccaaggccaagggccagccccgggaaccccaggtgtacacactgccccctagcagggacgagctgaccaagaaccaggtgtccctgacctgtctcgtgaaaggcttctacccctccgatatcgccgtggaatgggagtccaacggccagcctgagaacaactacaagaccaccccccctgtgctggactccgacggctcattcttcctgtacagcaagctgacagtggacaagtcccggtggcagcagggcaacgtgttctcctgctccgtgatgcacgaggccctgcacaaccactacacccagaagtccctgtccctgagccccggcaagtgatga

SEQ ID NO: 442 - protein, 6 aa, Homo Sapiens
QNINNF

SEQ ID NO: 443 - protein, 3 aa, Homo Sapiens
AAS

SEQ ID NO: 444 - protein, 8 aa, Homo Sapiens
QQSYGIPW

SEQ ID NO: 445 - protein, 106 aa, Homo Sapiens
DIQMTQSPSSLSASVGDRVTITCRASQNINNFLNWYQQKEGKGPKLLIYAASSLQRGIPSTFSGSGSGTDFTLTISSLQPEDFATYICQQSYGIPWVGQGTKVEIK

SEQ ID NO: 446 - DNA, 318 bp, Homo Sapiens
gacatccagatgacccagtctccatcctccctgtctgcatctgtaggagacagagtcaccatcacttgccgggcaagtcagaacattaataactttttaaattggtatcagcagaaagaagggaaaggccctaagctcctgatctatgcagcatccagtttgcaaagagggataccatcaacgttcagtggcagtggatctgggacagacttcactctcaccatcagcagtctgcaacctgaagattttgcaacttacatctgtcaacagagctacggtatcccgtgggtcggccaagggaccaaggtggaaatcaaa

SEQ ID NO: 447 - protein, 213 aa, Homo Sapiens
DIQMTQSPSSLSASVGDRVTITCRASQNINNFLNWYQQKEGKGPKLLIYAASSLQRGIPSTFSGSGSGTDFTLTISSLQPEDFATYICQQSYGIPWVGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 448 - DNA, 639 bp, Homo Sapiens
gacatccagatgacccagtctccatcctccctgtctgcatctgtaggagacagagtcaccatcacttgccgggcaagtcagaacattaataactttttaaattggtatcagcagaaagaagggaaaggccctaagctcctgatctatgcagcatccagtttgcaaagagggataccatcaacgttcagtggcagtggatctgggacagacttcactctcaccatcagcagtctgcaacctgaagattttgcaacttacatctgtcaacagagctacggtatcccgtgggtcggccaagggaccaaggtggaaatcaaacgtacggtggccgctccctccgtgttcatcttcccaccttccgacgagcagctgaagtccggcaccgcttctgtcgtgtgcctgctgaacaacttctacccccgcgaggccaaggtgcagtggaaggtggacaacgccctgcagtccggcaactcccaggaatccgtgaccgagcaggactccaaggacagcacctactccctgtcctccaccctgaccctgtccaaggccgactacgagaagcacaaggtgtacgcctgcgaagtgacccaccagggcctgtctagccccgtgaccaagtctttcaaccggggcgagtgt

SEQ ID NO: 449 - protein, 8 aa, Homo Sapiens
GFTFSDYF

SEQ ID NO: 450 - protein, 8 aa, Homo Sapiens
ISSSGSTI

SEQ ID NO: 451 - protein, 21 aa, Homo Sapiens
ARDHYDGSGIYPLYYYYGLDV

SEQ ID NO: 452 - protein, 128 aa, Homo Sapiens
QVQLVESGGGLVKPGGSLRLSCAASGFTFSDYFMSWIRQAPGKGLEWISYISSSGSTIYYADSVRGRFTISRDNAKYSLYLQMNSLRSEDTAVYYCARDHYDGSGIYPLYYYYGLDVWGQGTTVTVSS

SEQ ID NO: 453 - DNA, 384 bp, Homo Sapiens
caggtgcagctggtggagtctgggggaggcttggtcaagcctggagggtccctgagactctcctgtgcagcctctggattcaccttcagtgactacttcatgagctggatccgccaggcgccagggaaggggctggagtggatttcatacattagttctagtggtagtaccatatactacgcagactctgtgaggggccgattcaccatctccagggacaacgccaagtactcactgtatctgcaaatgaacagcctgagatccgaggacacggccgtgtattactgtgcgagagatcactacgatggttcggggatttatcccctctactactattacggtttggacgtctggggccaggggaccacggtcaccgtctcctca

SEQ ID NO: 454 - protein, 458 aa, Homo Sapiens
QVQLVESGGGLVKPGGSLRLSCAASGFTFSDYFMSWIRQAPGKGLEWISYISSSGSTIYYADSVRGRFTISRDNAKYSLYLQMNSLRSEDTAVYYCARDHYDGSGIYPLYYYYGLDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 455 - DNA, 1380 bp, Homo Sapiens
caggtgcagctggtggagtctgggggaggcttggtcaagcctggagggtccctgagactctcctgtgcagcctctggattcaccttcagtgactacttcatgagctggatccgccaggcgccagggaaggggctggagtggatttcatacattagttctagtggtagtaccatatactacgcagactctgtgaggggccgattcaccatctccagggacaacgccaagtactcactgtatctgcaaatgaacagcctgagatccgaggacacggccgtgtattactgtgcgagagatcactacgatggttcggggatttatcccctctactactattacggtttggacgtctggggccaggggaccacggtcaccgtctcctcagccagcaccaagggcccctctgtgttccctctggccccttccagcaagtccacctctggcggaacagccgctctgggctgcctcgtgaaggactacttccccgagcctgtgaccgtgtcctggaactctggcgctctgaccagcggagtgcacaccttccctgctgtgctgcagtcctccggcctgtactccctgtcctccgtcgtgaccgtgccttccagctctctgggcacccagacctacatctgcaacgtgaaccacaagccctccaacaccaaggtggacaagaaggtggaacccaagtcctgcgacaagacccacacctgtcccccttgtcctgcccctgaactgctgggcggaccttccgtgttcctgttccccccaaagcccaaggacaccctgatgatctcccggacccccgaagtgacctgcgtggtggtggatgtgtcccacgaggaccctgaagtgaagttcaattggtacgtggacggcgtggaagtgcacaacgccaagaccaagcctagagaggaacagtacaactccacctaccgggtggtgtccgtgctgaccgtgctgcaccaggattggctgaacggcaaagagtacaagtgcaaggtgtccaacaaggccctgcctgcccccatcgaaaagaccatctccaaggccaagggccagccccgggaaccccaggtgtacacactgccccctagcagggacgagctgaccaagaaccaggtgtccctgacctgtctcgtgaaaggcttctacccctccgatatcgccgtggaatgggagtccaacggccagcctgagaacaactacaagaccaccccccctgtgctggactccgacggctcattcttcctgtacagcaagctgacagtggacaagtcccggtggcagcagggcaacgtgttctcctgctccgtgatgcacgaggccctgcacaaccactacacccagaagtccctgtccctgagccccggcaagtgatga

SEQ ID NO: 456 - protein, 11 aa, Homo Sapiens
QSLLHSNGYNY

SEQ ID NO: 457 - protein, 3 aa, Homo Sapiens
LGS

SEQ ID NO: 458 - protein, 9 aa, Homo Sapiens
MQALQTPRS

SEQ ID NO: 459 - protein, 111 aa, Homo Sapiens
IVMTQSPLSLPVTPGEPASISCRSSQSLLHSNGYNYLDYYLQKPGQSPQLLIYLGSYRASGVPDRFSGSGSGTDFTLKISRVEAEDVGVYYCMQALQTPRSFGQGTTLEIK

SEQ ID NO: 460 - DNA, 333 bp, Homo Sapiens
attgtgatgactcagtctccactctccctacccgtcacccctggagagccggcctccatctcctgcaggtctagtcagagcctcctgcatagtaatggatacaactatttggattattacctgcagaagccagggcagtctccacagctcctgatctatttgggttcttatcgggcctccggggtccctgacaggttcagtggcagtggatcaggcacagattttacactgaaaatcagcagagtggaggctgaggatgttggggtttattactgcatgcaagctctacaaactcctcgcagttttggccaggggaccacgctggagatcaaa

SEQ ID NO: 461 - protein, 218 aa, Homo Sapiens
IVMTQSPLSLPVTPGEPASISCRSSQSLLHSNGYNYLDYYLQKPGQSPQLLIYLGSYRASGVPDRFSGSGSGTDFTLKISRVEAEDVGVYYCMQALQTPRSFGQGTTLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 462 - DNA, 654 bp, Homo Sapiens
attgtgatgactcagtctccactctccctacccgtcacccctggagagccggcctccatctcctgcaggtctagtcagagcctcctgcatagtaatggatacaactatttggattattacctgcagaagccagggcagtctccacagctcctgatctatttgggttcttatcgggcctccggggtccctgacaggttcagtggcagtggatcaggcacagattttacactgaaaatcagcagagtggaggctgaggatgttggggtttattactgcatgcaagctctacaaactcctcgcagttttggccaggggaccacgctggagatcaaacgtacggtggccgctccctccgtgttcatcttcccaccttccgacgagcagctgaagtccggcaccgcttctgtcgtgtgcctgctgaacaacttctacccccgcgaggccaaggtgcagtggaaggtggacaacgccctgcagtccggcaactcccaggaatccgtgaccgagcaggactccaaggacagcacctactccctgtcctccaccctgaccctgtccaaggccgactacgagaagcacaaggtgtacgcctgcgaagtgacccaccagggcctgtctagccccgtgaccaagtctttcaaccggggcgagtgt

SEQ ID NO: 463 - protein, 10 aa, Homo Sapiens
GFSLSTTGVG

SEQ ID NO: 464 - protein, 7 aa, Homo Sapiens
IYWDDDK

SEQ ID NO: 465 - protein, 16 aa, Homo Sapiens
THGYGSASYYHYGMDV

SEQ ID NO: 466 - protein, 124 aa, Homo Sapiens
QITLKESGPTLVKPTQTLTLTCTFSGFSLSTTGVGVGWIRQPPGKALEWLAVIYWDDDKRYSPSLKSRLTITKDTSKNQVVLTMTNMDPVDTATYFCTHGYGSASYYHYGMDVWGQGTTVTVSS

SEQ ID NO: 467 - DNA, 372 bp, Homo Sapiens
cagatcaccttgaaggagtctggtcctacgctggtgaaacccacacagaccctcacgctgacctgcaccttctctgggttctcactcagcactactggagtgggtgtgggctggatccgtcagcccccaggaaaggccctggagtggcttgcagtcatttattgggatgatgataagcgctacagcccatctctgaagagcagactcaccatcaccaaggacacctccaaaaaccaggtggtccttacaatgaccaacatggaccctgtggacacagccacatatttctgtacacacggatatggttcggcgagttattaccactacggtatggacgtctggggccaagggaccacggtcaccgtctcctca

SEQ ID NO: 468 - protein, 454 aa, Homo Sapiens
QITLKESGPTLVKPTQTLTLTCTFSGFSLSTTGVGVGWIRQPPGKALEWLAVIYWDDDKRYSPSLKSRLTITKDTSKNQVVLTMTNMDPVDTATYFCTHGYGSASYYHYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 469 - DNA, 1368 bp, Homo Sapiens
cagatcaccttgaaggagtctggtcctacgctggtgaaacccacacagaccctcacgctgacctgcaccttctctgggttctcactcagcactactggagtgggtgtgggctggatccgtcagcccccaggaaaggccctggagtggcttgcagtcatttattgggatgatgataagcgctacagcccatctctgaagagcagactcaccatcaccaaggacacctccaaaaaccaggtggtccttacaatgaccaacatggaccctgtggacacagccacatatttctgtacacacggatatggttcggcgagttattaccactacggtatggacgtctggggccaagggaccacggtcaccgtctcctcagccagcaccaagggcccctctgtgttccctctggccccttccagcaagtccacctctggcggaacagccgctctgggctgcctcgtgaaggactacttccccgagcctgtgaccgtgtcctggaactctggcgctctgaccagcggagtgcacaccttccctgctgtgctgcagtcctccggcctgtactccctgtcctccgtcgtgaccgtgccttccagctctctgggcacccagacctacatctgcaacgtgaaccacaagccctccaacaccaaggtggacaagaaggtggaacccaagtcctgcgacaagacccacacctgtcccccttgtcctgcccctgaactgctgggcggaccttccgtgttcctgttccccccaaagcccaaggacaccctgatgatctcccggacccccgaagtgacctgcgtggtggtggatgtgtcccacgaggaccctgaagtgaagttcaattggtacgtggacggcgtggaagtgcacaacgccaagaccaagcctagagaggaacagtacaactccacctaccgggtggtgtccgtgctgaccgtgctgcaccaggattggctgaacggcaaagagtacaagtgcaaggtgtccaacaaggccctgcctgcccccatcgaaaagaccatctccaaggccaagggccagccccgggaaccccaggtgtacacactgccccctagcagggacgagctgaccaagaaccaggtgtccctgacctgtctcgtgaaaggcttctacccctccgatatcgccgtggaatgggagtccaacggccagcctgagaacaactacaagaccaccccccctgtgctggactccgacggctcattcttcctgtacagcaagctgacagtggacaagtcccggtggcagcagggcaacgtgttctcctgctccgtgatgcacgaggccctgcacaaccactacacccagaagtccctgtccctgagccccggcaagtgatga

SEQ ID NO: 470 - protein, 6 aa, Homo Sapiens
QSVTNY

SEQ ID NO: 471 - protein, 3 aa, Homo Sapiens
DAS

SEQ ID NO: 472 - protein, 9 aa, Homo Sapiens
QHRSNWPLT

SEQ ID NO: 473 - protein, 107 aa, Homo Sapiens
EIVLTQSPATLSLSPGERATLSCRASQSVTNYLAWHQQKPGQAPRLLIYDASNRATGIPARFSGSGSGTDFTLTISSLEPEDFAVYYCQHRSNWPLTFGGGTKVEIK

SEQ ID NO: 474 - DNA, 322 bp, Homo Sapiens
gaaattgtattgacacagtctccagccaccctgtctttgtctccaggggaaagagccaccctctcctgcagggccagtcagagtgttaccaactacttagcctggcaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcaccgtagcaactggcctctcactttcggcggagggaccaaggtggagatcaaac

SEQ ID NO: 475 - protein, 214 aa, Homo Sapiens
EIVLTQSPATLSLSPGERATLSCRASQSVTNYLAWHQQKPGQAPRLLIYDASNRATGIPARFSGSGSGTDFTLTISSLEPEDFAVYYCQHRSNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 476 - DNA, 643 bp, Homo Sapiens
gaaattgtattgacacagtctccagccaccctgtctttgtctccaggggaaagagccaccctctcctgcagggccagtcagagtgttaccaactacttagcctggcaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcaccgtagcaactggcctctcactttcggcggagggaccaaggtggagatcaaaccgtacggtggccgctccctccgtgttcatcttcccaccttccgacgagcagctgaagtccggcaccgcttctgtcgtgtgcctgctgaacaacttctacccccgcgaggccaaggtgcagtggaaggtggacaacgccctgcagtccggcaactcccaggaatccgtgaccgagcaggactccaaggacagcacctactccctgtcctccaccctgaccctgtccaaggccgactacgagaagcacaaggtgtacgcctgcgaagtgacccaccagggcctgtctagccccgtgaccaagtctttcaaccggggcgagtgt

SEQ ID NO: 477 - protein, 10 aa, Homo Sapiens
GFSLSTSGVG

SEQ ID NO: 478 - protein, 7 aa, Homo Sapiens
IYWDDDK

SEQ ID NO: 479 - protein, 16 aa, Homo Sapiens
THGYGSASYYHYGMDV

SEQ ID NO: 480 - protein, 124 aa, Homo Sapiens
QITLKESGPTLVKPTQTLTLTCTFSGFSLSTSGVGVGWIRQPPGKALEWLAVIYWDDDKRYSPSLKSRLTITKDTSKNQVVLTMTNMDPVDTATYFCTHGYGSASYYHYGMDVWGQGTTVTVSS

SEQ ID NO: 481 - DNA, 372 bp, Homo Sapiens
cagatcaccttgaaggagtctggtcctacgctggtgaaacccacacagaccctcacgctgacctgcaccttctctgggttctcactcagcactagtggagtgggtgtgggctggatccgtcagcccccaggaaaggccctggagtggcttgcagtcatttattgggatgatgataagcgctacagcccatctctgaagagcaggctcaccatcaccaaggacacctccaaaaaccaggtggtccttacaatgaccaacatggaccctgtggacacagccacatatttctgtacacacggatatggttcggcgagttattaccactacggtatggacgtctggggccaagggaccacggtcaccgtctcctca

SEQ ID NO: 482 - protein, 454 aa, Homo Sapiens
QITLKESGPTLVKPTQTLTLTCTFSGFSLSTSGVGVGWIRQPPGKALEWLAVIYWDDDKRYSPSLKSRLTITKDTSKNQVVLTMTNMDPVDTATYFCTHGYGSASYYHYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 483 - DNA, 1368 bp, Homo Sapiens
cagatcaccttgaaggagtctggtcctacgctggtgaaacccacacagaccctcacgctgacctgcaccttctctgggttctcactcagcactagtggagtgggtgtgggctggatccgtcagcccccaggaaaggccctggagtggcttgcagtcatttattgggatgatgataagcgctacagcccatctctgaagagcaggctcaccatcaccaaggacacctccaaaaaccaggtggtccttacaatgaccaacatggaccctgtggacacagccacatatttctgtacacacggatatggttcggcgagttattaccactacggtatggacgtctggggccaagggaccacggtcaccgtctcctcagccagcaccaagggcccctctgtgttccctctggccccttccagcaagtccacctctggcggaacagccgctctgggctgcctcgtgaaggactacttccccgagcctgtgaccgtgtcctggaactctggcgctctgaccagcggagtgcacaccttccctgctgtgctgcagtcctccggcctgtactccctgtcctccgtcgtgaccgtgccttccagctctctgggcacccagacctacatctgcaacgtgaaccacaagccctccaacaccaaggtggacaagaaggtggaacccaagtcctgcgacaagacccacacctgtcccccttgtcctgcccctgaactgctgggcggaccttccgtgttcctgttccccccaaagcccaaggacaccctgatgatctcccggacccccgaagtgacctgcgtggtggtggatgtgtcccacgaggaccctgaagtgaagttcaattggtacgtggacggcgtggaagtgcacaacgccaagaccaagcctagagaggaacagtacaactccacctaccgggtggtgtccgtgctgaccgtgctgcaccaggattggctgaacggcaaagagtacaagtgcaaggtgtccaacaaggccctgcctgcccccatcgaaaagaccatctccaaggccaagggccagccccgggaaccccaggtgtacacactgccccctagcagggacgagctgaccaagaaccaggtgtccctgacctgtctcgtgaaaggcttctacccctccgatatcgccgtggaatgggagtccaacggccagcctgagaacaactacaagaccaccccccctgtgctggactccgacggctcattcttcctgtacagcaagctgacagtggacaagtcccggtggcagcagggcaacgtgttctcctgctccgtgatgcacgaggccctgcacaaccactacacccagaagtccctgtccctgagccccggcaagtgatga

SEQ ID NO: 484 - protein, 6 aa, Homo Sapiens
QSVTNY

SEQ ID NO: 485 - protein, 3 aa, Homo Sapiens
DAS

SEQ ID NO: 486 - protein, 9 aa, Homo Sapiens
QQRSNWPLT

SEQ ID NO: 487 - protein, 107 aa, Homo Sapiens
EIVLTQSPATLSLSPGERATLSCRASQSVTNYLAWHQQKPGQAPRLLIYDASNRATGIPARFSGSGSGTDFTLTISSLEPEDFAVYYCQQRSNWPLTFGGGTKVEIK

SEQ ID NO: 488 - DNA, 321 bp, Homo Sapiens
gaaattgtgttgacacagtctccagccaccctgtctttgtctccaggggaaagagccaccctctcctgcagggccagtcagagtgttaccaactacttagcctggcaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggcctctcactttcggcggagggaccaaggtggagatcaaa

SEQ ID NO: 489 - protein, 214 aa, Homo Sapiens
EIVLTQSPATLSLSPGERATLSCRASQSVTNYLAWHQQKPGQAPRLLIYDASNRATGIPARFSGSGSGTDFTLTISSLEPEDFAVYYCQQRSNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 490 - DNA, 642 bp, Homo Sapiens
gaaattgtgttgacacagtctccagccaccctgtctttgtctccaggggaaagagccaccctctcctgcagggccagtcagagtgttaccaactacttagcctggcaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggcctctcactttcggcggagggaccaaggtggagatcaaacgtacggtggccgctccctccgtgttcatcttcccaccttccgacgagcagctgaagtccggcaccgcttctgtcgtgtgcctgctgaacaacttctacccccgcgaggccaaggtgcagtggaaggtggacaacgccctgcagtccggcaactcccaggaatccgtgaccgagcaggactccaaggacagcacctactccctgtcctccaccctgaccctgtccaaggccgactacgagaagcacaaggtgtacgcctgcgaagtgacccaccagggcctgtctagccccgtgaccaagtctttcaaccggggcgagtgt

SEQ ID NO: 491 - protein, 8 aa, Homo Sapiens
GFTFSDYY

SEQ ID NO: 492 - protein, 8 aa, Homo Sapiens
ISSSGSTI

SEQ ID NO: 493 - protein, 20 aa, Homo Sapiens
ARDFYDILTDSPYFYYGVDV

SEQ ID NO: 494 - protein, 127 aa, Homo Sapiens
QVQLVESGGGLVKPGGSLRLSCAASGFTFSDYYMSWIRQAPGKGLEWVSYISSSGSTIYYADSVKGRFTISRDNAKNSLYLQINSLRAEDTAVYYCARDFYDILTDSPYFYYGVDVWGQGTTVTVSS

SEQ ID NO: 495 - DNA, 381 bp, Homo Sapiens
caggtgcagctggtggagtctgggggaggcttggtcaagcctggagggtccctgagactctcctgtgcagcctctggattcaccttcagtgactactacatgagctggatccgccaggctccagggaaggggctggagtgggtttcatacattagtagtagtggtagtaccatatactacgcagactctgtgaagggccgattcaccatctccagggacaacgccaagaactcactgtatctgcaaattaacagcctgagagccgaggacacggccgtgtattactgtgcgagagatttttacgatattttgactgatagtccgtacttctactacggtgtggacgtctggggccaagggaccacggtcaccgtctcctca

SEQ ID NO: 496 - protein, 457 aa, Homo Sapiens
QVQLVESGGGLVKPGGSLRLSCAASGFTFSDYYMSWIRQAPGKGLEWVSYISSSGSTIYYADSVKGRFTISRDNAKNSLYLQINSLRAEDTAVYYCARDFYDILTDSPYFYYGVDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 497 - DNA, 1377 bp, Homo Sapiens
caggtgcagctggtggagtctgggggaggcttggtcaagcctggagggtccctgagactctcctgtgcagcctctggattcaccttcagtgactactacatgagctggatccgccaggctccagggaaggggctggagtgggtttcatacattagtagtagtggtagtaccatatactacgcagactctgtgaagggccgattcaccatctccagggacaacgccaagaactcactgtatctgcaaattaacagcctgagagccgaggacacggccgtgtattactgtgcgagagatttttacgatattttgactgatagtccgtacttctactacggtgtggacgtctggggccaagggaccacggtcaccgtctcctcagccagcaccaagggcccctctgtgttccctctggccccttccagcaagtccacctctggcggaacagccgctctgggctgcctcgtgaaggactacttccccgagcctgtgaccgtgtcctggaactctggcgctctgaccagcggagtgcacaccttccctgctgtgctgcagtcctccggcctgtactccctgtcctccgtcgtgaccgtgccttccagctctctgggcacccagacctacatctgcaacgtgaaccacaagccctccaacaccaaggtggacaagaaggtggaacccaagtcctgcgacaagacccacacctgtcccccttgtcctgcccctgaactgctgggcggaccttccgtgttcctgttccccccaaagcccaaggacaccctgatgatctcccggacccccgaagtgacctgcgtggtggtggatgtgtcccacgaggaccctgaagtgaagttcaattggtacgtggacggcgtggaagtgcacaacgccaagaccaagcctagagaggaacagtacaactccacctaccgggtggtgtccgtgctgaccgtgctgcaccaggattggctgaacggcaaagagtacaagtgcaaggtgtccaacaaggccctgcctgcccccatcgaaaagaccatctccaaggccaagggccagccccgggaaccccaggtgtacacactgccccctagcagggacgagctgaccaagaaccaggtgtccctgacctgtctcgtgaaaggcttctacccctccgatatcgccgtggaatgggagtccaacggccagcctgagaacaactacaagaccaccccccctgtgctggactccgacggctcattcttcctgtacagcaagctgacagtggacaagtcccggtggcagcagggcaacgtgttctcctgctccgtgatgcacgaggccctgcacaaccactacacccagaagtccctgtccctgagccccggcaagtgatga

SEQ ID NO: 498 - protein, 11 aa, Homo Sapiens
QSLLHSNGYNY

SEQ ID NO: 499 - protein, 3 aa, Homo Sapiens
LGS

SEQ ID NO: 500 - protein, 9 aa, Homo Sapiens
MQALQTPRT

SEQ ID NO: 501 - protein, 112 aa, Homo Sapiens
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPRTFGQGTKVEIK

SEQ ID NO: 502 - DNA, 336 bp, Homo Sapiens
gatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactcctcggacgttcggccaagggaccaaggtggaaatcaaa

SEQ ID NO: 503 - protein, 219 aa, Homo Sapiens
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 504 - DNA, 657 bp, Homo Sapiens
gatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactcctcggacgttcggccaagggaccaaggtggaaatcaaacgtacggtggccgctccctccgtgttcatcttcccaccttccgacgagcagctgaagtccggcaccgcttctgtcgtgtgcctgctgaacaacttctacccccgcgaggccaaggtgcagtggaaggtggacaacgccctgcagtccggcaactcccaggaatccgtgaccgagcaggactccaaggacagcacctactccctgtcctccaccctgaccctgtccaaggccgactacgagaagcacaaggtgtacgcctgcgaagtgacccaccagggcctgtctagccccgtgaccaagtctttcaaccggggcgagtgt

SEQ ID NO: 505 - protein, 239 aa, Homo Sapiens
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERTIEGRDYKDDDDKHHHHHH

SEQ ID NO: 506 - protein, 179 aa, Homo Sapiens
EINGSANYEMFIFHNGGVQILCKYPDIVQQFKMQLLKGGQILCDLTKTKGSGNTVSIKSLKFCHSQLSNNSVSFFLYNLDHSHANYYFCNLSIFDPPPFKVTLTGGYLHIYESQLCCQLKFWLPIGCAAFVVVCILGCILICWLTKKKYSSSVHDPNGEYMFMRAVNTAKKSRLTDVTL

SEQ ID NO: 507 - protein, 121 aa, Homo Sapiens
EINGSANYEMFIFHNGGVQILCKYPDIVQQFKMQLLKGGQILCDLTKTKGSGNTVSIKSLKFCHSQLSNNSVSFFLYNLDHSHANYYFCNLSIFDPPPFKVTLTGGYLHIYESQLCCQLKF

SEQ ID NO: 508 - protein, 199 aa, Homo Sapiens
MKSGLWYFFLFCLRIKVLTGEINGSANYEMFIFHNGGVQILCKYPDIVQQFKMQLLKGGQILCDLTKTKGSGNTVSIKSLKFCHSQLSNNSVSFFLYNLDHSHANYYFCNLSIFDPPPFKVTLTGGYLHIYESQLCCQLKFWLPIGCAAFVVVCILGCILICWLTKKKYSSSVHDPNGEYMFMRAVNTAKKSRLTDVTL

SEQ ID NO: 509 - protein, 33 aa, Homo Sapiens
KYSSSVHDPNGEYMFMRAVNTAKKSRLTDVTLM

SEQ ID NO: 510 - protein, 128 aa, Mus Musculus
EINGSADHRMFSFHNGGVQISCKYPETVQQLKMRLFREREVLCELTKTKGSGNAVSIKNPMLCLYHLSNNSVSFFLNNPDSSQGSYYFCSLSIFDPPPFQERNLSGGYLHIYESQLCCQLKIVVQVTE

SEQ ID NO: 511 - protein, 121 aa, Mus Musculus
EINGSADHRMFSFHNGGVQISCKYPETVQQLKMRLFREREVLCELTKTKGSGNAVSIKNPMLCLYHLSNNSVSFFLNNPDSSQGSYYFCSLSIFDPPPFQERNLSGGYLHIYESQLCCQLK

SEQ ID NO: 512 - protein, 147 aa, Mus Musculus
MGWSCIILFLVATATGVHSEINGSADHRMFSFHNGGVQISCKYPETVQQLKMRLFREREVLCELTKTKGSGNAVSIKNPMLCLYHLSNNSVSFFLNNPDSSQGSYYFCSLSIFDPPPFQERNLSGGYLHIYESQLCCQLKIVVQVTE

SEQ ID NO: 513 - protein, 199 aa, Cynomologus
MKSGLWYFFLFCLHMKVLTGEINGSANYEMFIFHNGGVQILCKYPDIVQQFKMQLLKGGQILCDLTKTKGSGNKVSIKSLKFCHSQLSNNSVSFFLYNLDRSHANYYFCNLSIFDPPPFKVTLTGGYLHIYESQLCCQLKFWLPIGCATFVVVCIFGCILICWLTKKKYSSTVHDPNGEYMFMRAVNTAKKSRLTGTTP

SEQ ID NO: 514 - protein, 120 aa, Cynomologus
EINGSANYEMFIFHNGGVQILCKYPDIVQQFKMQLLKGGQILCDLTKTKGSGNKVSIKSLKFCHSQLSNNSVSFFLYNLDRSHANYYFCNLSIFDPPPFKVTLTGGYLHIYESQLCCQLK

SEQ ID NO: 515 - protein, 240 aa, Homo Sapiens
DTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAATWS

SEQ ID NO: 516 - protein, 302 aa, Homo Sapiens
MRLGSPGLLFLLFSSLRADTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAATWSILAVLCLLVVVAVAIGWVCRDRCLQHSYAGAWAVSPETELTGHV

SEQ ID NO: 517 - protein, 113 aa, Homo Sapiens
LQMILNGINNYKNPKLTAMLTFKFYMPKKATELKHLQCLEEELKPLEEVLNLAQSKNFHLRPRDLISNINVIVLELKGSETTFMCEYADETATIVEFLNRWITFCQSIISTLT

SEQ ID NO: 518 - protein, 113 aa, Homo Sapiens
LQMILNGINNYKNPKLTQMLTFKFYMPKKATELKHLQCLEEELKPLEEVLNLAQSKNFHLRPRDLISNINVIVLELKGSETTFMCEYADETATIVEFLNRWITFCQSIISTLT

SEQ ID NO: 519 - DNA, 336 bp, Homo Sapiens
gatattgtgatgactcagtctccactctccctgcccgtcacccctggagagccggcctccatctcctgcaggtctagtcagagcctcctgcatagtgatggatacaactatttggattggtacctgcagaagccagggcagtctccacagctcctgatctatttgggttctactcgggcctccgggttccctgacaggttcagtggcagtggatcaggcacagattttacactgaaaatcagcagagtggaggctgaggatgttggggtttattactgcatgcaagctctacaaactccgctcagttttggccaggggaccaagctggagatcaaa

SEQ ID NO: 520 - DNA, 657 bp, Homo Sapiens
gatattgtgatgactcagtctccactctccctgcccgtcacccctggagagccggcctccatctcctgcaggtctagtcagagcctcctgcatagtgatggatacaactatttggattggtacctgcagaagccagggcagtctccacagctcctgatctatttgggttctactcgggcctccgggttccctgacaggttcagtggcagtggatcaggcacagattttacactgaaaatcagcagagtggaggctgaggatgttggggtttattactgcatgcaagctctacaaactccgctcagttttggccaggggaccaagctggagatcaaacgtacggtggccgctccctccgtgttcatcttcccaccttccgacgagcagctgaagtccggcaccgcttctgtcgtgtgcctgctgaacaacttctacccccgcgaggccaaggtgcagtggaaggtggacaacgccctgcagtccggcaactcccaggaatccgtgaccgagcaggactccaaggacagcacctactccctgtcctccaccctgaccctgtccaaggccgactacgagaagcacaaggtgtacgcctgcgaagtgacccaccagggcctgtctagccccgtgaccaagtctttcaaccggggcgagtgt

SEQ ID NO: 521 - DNA, 372 bp, Homo Sapiens
gaggtgcagctggtggagtctgggggaggtgtggtacggcctggggggtccctgagactctcctgtgtagcctctggagtcacctttgatgattatggcatgagctgggtccgccaagctccagggaaggggctggagtgggtctctggtattaattggaatggtggcgacacagattattcagactctgtgaagggccgattcaccatctccagagacaacgccaagaactccctgtatctacaaatgaatagtctgagagccgaggacacggccttgtattactgtgcgagggatttctatggttcggggagttattatcacgttccttttgactactggggccagggaatcctggtcaccgtctcctca

SEQ ID NO: 522 - DNA, 1368 bp, Homo Sapiens
gaggtgcagctggtggagtctgggggaggtgtggtacggcctggggggtccctgagactctcctgtgtagcctctggagtcacctttgatgattatggcatgagctgggtccgccaagctccagggaaggggctggagtgggtctctggtattaattggaatggtggcgacacagattattcagactctgtgaagggccgattcaccatctccagagacaacgccaagaactccctgtatctacaaatgaatagtctgagagccgaggacacggccttgtattactgtgcgagggatttctatggttcggggagttattatcacgttccttttgactactggggccagggaatcctggtcaccgtctcctcagccagcaccaagggcccctctgtgttccctctggccccttccagcaagtccacctctggcggaacagccgctctgggctgcctcgtgaaggactacttccccgagcctgtgaccgtgtcctggaactctggcgctctgaccagcggagtgcacaccttccctgctgtgctgcagtcctccggcctgtactccctgtcctccgtcgtgaccgtgccttccagctctctgggcacccagacctacatctgcaacgtgaaccacaagccctccaacaccaaggtggacaagaaggtggaacccaagtcctgcgacaagacccacacctgtcccccttgtcctgcccctgaactgctgggcggaccttccgtgttcctgttccccccaaagcccaaggacaccctgatgatctcccggacccccgaagtgacctgcgtggtggtggatgtgtcccacgaggaccctgaagtgaagttcaattggtacgtggacggcgtggaagtgcacaacgccaagaccaagcctagagaggaacagtacaactccacctaccgggtggtgtccgtgctgaccgtgctgcaccaggattggctgaacggcaaagagtacaagtgcaaggtgtccaacaaggccctgcctgcccccatcgaaaagaccatctccaaggccaagggccagccccgggaaccccaggtgtacacactgccccctagcagggacgagctgaccaagaaccaggtgtccctgacctgtctcgtgaaaggcttctacccctccgatatcgccgtggaatgggagtccaacggccagcctgagaacaactacaagaccaccccccctgtgctggactccgacggctcattcttcctgtacagcaagctgacagtggacaagtcccggtggcagcagggcaacgtgttctcctgctccgtgatgcacgaggccctgcacaaccactacacccagaagtccctgtccctgagccccggcaagtgatga

SEQ ID NO: 523 - DNA, 990 bp, Homo Sapiens
gcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggtaaa

SEQ ID NO: 524 - protein, 330 aa, Homo Sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 525 - DNA, 990 bp, Homo Sapiens
gcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacatcttctcatgctccgtgatgcatgaggctctgcacaaccactacacgcagaagagcctctccctgtctccgggtaaa

SEQ ID NO: 526 - protein, 330 aa, Homo Sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNIFSCSVMHEALHNHYTQKSLSLSPGK

SEQ ID NO: 527 - DNA, 978 bp, Homo Sapiens
gcctccaccaagggcccatcggtcttccccctggcgccctgctccaggagcacctccgagagcacagccgccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 528 - protein, 326 aa, Homo Sapiens
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 529 - DNA, 978 bp, Homo Sapiens
gcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccggctgtcctacagtcctcaggactctactccctcagcagcgtggtgaccgtgacctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcatggaggtgcataatgccaagacaaagccacgggaggagcagttcaacagcacgttccgtgtggtcagcgtcctcaccgtcgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacacagaagagcctctccctgtctccgggtaaa

SEQ ID NO: 530 - protein, 326 aa, Homo Sapiens
ASTKGPSVFPLAPCSRSTSESTAALGCLVKDYFPEPVTVSWNSGALTSGVHTFPAVLQSSGLYSLSSVVTVTSSNFGTQTYTCNVDHKPSNTKVDKTVERKCCVECPPCPAPPVAGPSVFLFPPKPKDTLMISRTPEVTCVVVDVSHEDPEVQFNWYVDGMEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 531 - DNA, 978 bp, Homo Sapiens
gcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcagcttgggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 532 - protein, 326 aa, Homo Sapiens
ASTKGPSVFPLAPCSRSTSESTAALGCLVKDYFPEPVTVSWNSGALTSGVHTFPAVLQSSGLYSLSSVVTVPSSSLGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 533 - DNA, 978 bp, Homo Sapiens
gcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccggctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgtcgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatctccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacacagaagagcctctccctgtctccgggtaaa

SEQ ID NO: 534 - protein, 326 aa, Homo Sapiens
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDISVEWESNGQPENNYKTTPPMLDSDGSFFLYSKLTVDKSRWQQGNVFSCSVMHEALHNHYTQKSLSLSPGK

SEQ ID NO: 535 - DNA, 318 bp, Homo Sapiens
ggtcagcccaaggctgccccctcggtcactctgttcccaccctcctctgaggagcttcaagccaacaaggccacactggtgtgtctcgtaagtgacttcaacccgggagccgtgacagtggcctggaaggcagatggcagccccgtcaaggtgggagtggagaccaccaaaccctccaaacaaagcaacaacaagtatgcggccagcagctacctgagcctgacgcccgagcagtggaagtcccacagaagctacagctgccgggtcacgcatgaagggagcaccgtggagaagacagtggcccctgcagaatgctct

SEQ ID NO: 536 - protein, 106 aa, Homo Sapiens
GQPKAAPSVTLFPPSSEELQANKATLVCLVSDFNPGAVTVAWKADGSPVKVGVETTKPSKQSNNKYAASSYLSLTPEQWKSHRSYSCRVTHEGSTVEKTVAPAECS

SEQ ID NO: 537 - DNA, 990 bp, Homo Sapiens
gcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgggtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 538 - protein, 106 aa, Homo Sapiens; identical to SEQ ID NO: 225

SEQ ID NO: 539 - protein, 663 aa, Homo Sapiens
DIQMTQSPASLSASLGETVTIQCRASEDIYSGLAWFQQKPGKSPQLLIYGASSLQDGVPSRFSGSGSGTQYSLKISSMQTEDEGVYFCQQGLKYPPTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECEVQLVESGGGLTQPGKSLKLSCEASGFTFSSFTMHWVRQSPGKGLEWVAFIRSGSGIVFYADAVRGRFTISRDNAKNLLFLQMNDLKSEDTAMYYCARRPLGHNTFDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 540 - protein, 215 aa, Homo Sapiens
EVQLVESGGGLVQPGRSLKLSCAASGFTFSDFYMAWVRQAPKKGLEWVASISYEGSSTYYGDSVMGRFTISRDNAKSTLYLQMNSLRSEDTATYYCARQREANWEDWGQGVMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKV

SEQ ID NO: 541 - protein, 220 aa, Homo Sapiens
DIVMTQSPSSLAVSPGEKVTMTCKSSQSLYYSGVKENLLAWYQQKPGQSPKLLIYYASIRFTGVPDRFTGSGSGTDYTLTITSVQAEDMGQYFCQQGINNPLTFGDGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 542 - protein, 667 aa, Homo Sapiens
DIVMTQSPSSLAVSPGEKVTMTCKSSQSLYYSGVKENLLAWYQQKPGQSPKLLIYYASIRFTGVPDRFTGSGSGTDYTLTITSVQAEDMGQYFCQQGINNPLTFGDGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECEVQLVESGGGLVQPGRSLKLSCAASGFTFSDFYMAWVRQAPKKGLEWVASISYEGSSTYYGDSVMGRFTISRDNAKSTLYLQMNSLRSEDTATYYCARQREANWEDWGQGVMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 543 - protein, 217 aa, Homo Sapiens
EVQLVESGGGLTQPGKSLKLSCEASGFTFSSFTMHWVRQSPGKGLEWVAFIRSGSGIVFYADAVRGRFTISRDNAKNLLFLQMNDLKSEDTAMYYCARRPLGHNTFDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKV

SEQ ID NO: 544 - protein, 214 aa, Homo Sapiens
DIQMTQSPASLSASLGETVTIQCRASEDIYSGLAWFQQKPGKSPQLLIYGASSLQDGVPSRFSGSGSGTQYSLKISSMQTEDEGVYFCQQGLKYPPTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 545 - protein, 663 aa, Homo Sapiens
DIQMTQSPASLSASLGETVTIQCRASEDIYSGLAWFQQKPGKSPQLLIYGASSLQDGVPSRFSGSGSGTQYSLKISSMQTEDEGVYFCQQGLKYPPTFGSGTKLEIKRTDAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNECEVQLVESGGGLTQPGKSLKLSCEASGFTFSSFTMHWVRQSPGKGLEWVAFIRSGSGIVFYADAVRGRFTISRDNAKNLLFLQMNDLKSEDTAMYYCARRPLGHNTFDSWGQGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 546 - protein, 214 aa, Homo Sapiens
EVQLVESGGGLVQPGRSLKLSCAASGFTFSDFYMAWVRQAPKKGLEWVASISYEGSSTYYGDSVMGRFTISRDNAKSTLYLQMNSLRSEDTATYYCARQREANWEDWGQGVMVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKI

SEQ ID NO: 547 - protein, 220 aa, Homo Sapiens
DIVMTQSPSSLAVSPGEKVTMTCKSSQSLYYSGVKENLLAWYQQKPGQSPKLLIYYASIRFTGVPDRFTGSGSGTDYTLTITSVQAEDMGQYFCQQGINNPLTFGDGTKLEIKRTDAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 548 - protein, 667 aa, Homo Sapiens
DIVMTQSPSSLAVSPGEKVTMTCKSSQSLYYSGVKENLLAWYQQKPGQSPKLLIYYASIRFTGVPDRFTGSGSGTDYTLTITSVQAEDMGQYFCQQGINNPLTFGDGTKLEIKRTDAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNECEVQLVESGGGLVQPGRSLKLSCAASGFTFSDFYMAWVRQAPKKGLEWVASISYEGSSTYYGDSVMGRFTISRDNAKSTLYLQMNSLRSEDTATYYCARQREANWEDWGQGVMVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 549 - protein, 216 aa, Homo Sapiens
EVQLVESGGGLTQPGKSLKLSCEASGFTFSSFTMHWVRQSPGKGLEWVAFIRSGSGIVFYADAVRGRFTISRDNAKNLLFLQMNDLKSEDTAMYYCARRPLGHNTFDSWGQGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKI

SEQ ID NO: 550 - protein, 214 aa, Homo Sapiens
DIQMTQSPASLSASLGETVTIQCRASEDIYSGLAWFQQKPGKSPQLLIYGASSLQDGVPSRFSGSGSGTQYSLKISSMQTEDEGVYFCQQGLKYPPTFGSGTKLEIKRTDAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 551 - protein, 659 aa, Homo Sapiens
DIQMTQSPASLSASLGETVTIQCRASEDIYSGLAWFQQKPGKSPQLLIYGASSLQDGVPSRFSGSGSGTQYSLKISSMQTEDEGVYFCQQGLKYPPTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECEVQLVESGGGLTQPGKSLKLSCEASGFTFSSFTMHWVRQSPGKGLEWVAFIRSGSGIVFYADAVRGRFTISRDNAKNLLFLQMNDLKSEDTAMYYCARRPLGHNTFDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 552 - protein, 215 aa, Homo Sapiens; identical to SEQ ID NO: 540

SEQ ID NO: 553 - protein, 220 aa, Homo Sapiens; identical to SEQ ID NO: 541

SEQ ID NO: 554 - protein, 663 aa, Homo Sapiens
DIVMTQSPSSLAVSPGEKVTMTCKSSQSLYYSGVKENLLAWYQQKPGQSPKLLIYYASIRFTGVPDRFTGSGSGTDYTLTITSVQAEDMGQYFCQQGINNPLTFGDGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECEVQLVESGGGLVQPGRSLKLSCAASGFTFSDFYMAWVRQAPKKGLEWVASISYEGSSTYYGDSVMGRFTISRDNAKSTLYLQMNSLRSEDTATYYCARQREANWEDWGQGVMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 555 - protein, 217 aa, Homo Sapiens; identical to SEQ ID NO: 543

SEQ ID NO: 556 - protein, 214 aa, Homo Sapiens; identical to SEQ ID NO: 544

SEQ ID NO: 557 - protein, 659 aa, Homo Sapiens; identical to SEQ ID NO: 551

SEQ ID NO: 558 - protein, 215 aa, Homo Sapiens; identical to SEQ ID NO: 540

SEQ ID NO: 559 - protein, 220 aa, Homo Sapiens; identical to SEQ ID NO: 541

SEQ ID NO: 560 - protein, 663 aa, Homo Sapiens; identical to SEQ ID NO: 554

SEQ ID NO: 561 - protein, 217 aa, Homo Sapiens; identical to SEQ ID NO: 543

SEQ ID NO: 562 - protein, 214 aa, Homo Sapiens; identical to SEQ ID NO: 544

SEQ ID NO: 563 - DNA, 364 bp, Homo Sapiens
caggttcaactgatgcagtctggaactgaggtgaagaagcctggggcctcagtgaaggtctcctgcaagacttctggttacacctttaccacctatggtatcacttgggtgcgacaggcccctggacaagggcttgagtggatgggatggatcagcgcttacagtggtgacacagactatgcacagaagttccagggcagagtcaccgtgacaacagacacatccacgaacacagcctacatggagttgaggagcctgaaatctgacgacacggccgtgtattattgtgcgagaagtagtggctggccccaccactacggtatggacgtctggggccaagggaccacggtcaccgtctcctcag

SEQ ID NO: 564 - protein, 121 aa, Homo Sapiens
QVQLMQSGTEVKKPGASVKVSCKTSGYTFTTYGITWVRQAPGQGLEWMGWISAYSGDTDYAQKFQGRVTVTTDTSTNTAYMELRSLKSDDTAVYYCARSSGWPHHYGMDVWGQGTTVTVSS

SEQ ID NO: 565 - protein, 8 aa, Homo Sapiens
GYTFTTYG

SEQ ID NO: 566 - protein, 8 aa, Homo Sapiens
ISAYSGDT

SEQ ID NO: 567 - protein, 14 aa, Homo Sapiens
ARSSGWPHHYGMDV

SEQ ID NO: 568 - DNA, 373 bp, Homo Sapiens
caggttcaactggtgcagtctggaggtgaggtgaaaaagcctggggcctcagtgaaggtctcctgcaaggcttctggttacacctttaccagctatggtttcagctgggtgcgacaggcccctggacaaggactagagtggatgggatggatcagcgcttacaatggtaacacaaactatgcacagaagctccagggcagagtctccatgaccacagacacatccacgagcacagcctacatggagctgaggagcttgagatctgacgacacggccgtgtatttctgtgcgcgatctacgtcttactatggttcggggaccctatacggtatggacgtctggggccaagggaccacggtcaccgtctcctcag

SEQ ID NO: 569 - protein, 124 aa, Homo Sapiens
QVQLVQSGGEVKKPGASVKVSCKASGYTFTSYGFSWVRQAPGQGLEWMGWISAYNGNTNYAQKLQGRVSMTTDTSTSTAYMELRSLRSDDTAVYFCARSTSYYGSGTLYGMDVWGQGTTVTVSS

SEQ ID NO: 570 - protein, 17 aa, Homo Sapiens
ARSTSYYGSGTLYGMDV

SEQ ID NO: 571 - DNA, 373 bp, Homo Sapiens
caggttcaactggtgcagtctggaggtgaggtgaagaagcctggggcctcagtgaaggtctcctgcaaggcttctggttacacctttaccagctatggtttcagctgggtgcgacaggcccctggacaaggactagagtggatgggatggatcagcgcttacaatggtaacacaaactatgcacagaagctccagggcagagtctccatgaccacagacacatccacgagcacagcctacatggagctgaggagcttgagatctgacgacacggccgtgtattactgtgcgcgatctacgtcttactatggttcggggaccctctacggtatggacgtctggggccaagggaccacggtcaccgtctcctcag

SEQ ID NO: 572 - protein, 124 aa, Homo Sapiens
QVQLVQSGGEVKKPGASVKVSCKASGYTFTSYGFSWVRQAPGQGLEWMGWISAYNGNTNYAQKLQGRVSMTTDTSTSTAYMELRSLRSDDTAVYYCARSTSYYGSGTLYGMDVWGQGTTVTVSS

SEQ ID NO: 573 - DNA, 373 bp, Homo Sapiens; identical to SEQ ID NO: 568

SEQ ID NO: 574 - protein, 124 aa, Homo Sapiens; identical to SEQ ID NO: 569

SEQ ID NO: 575 - DNA, 373 bp, Homo Sapiens
caggttcaactggtgcagtctggaggtgaggtgaaaaagcctcgggcctcagtgaaggtctcctgcaaggcttctggttacacctttaccagctatgtgttcagctgggtgcgacatgccgctggacaaggactagagtggatgggatggatcagcggttacaatggtaacacaaactatgcacagaagctccagtgcggagtctcgatgaccgcagacacatccacgagcacagcctacatggagctgaggagcttgagatctgacgacacggccgtgtatttctgtgcgcgatctacgtcttactatggtgcggggaccctatacggtatggacgtctggggccaagggaccacggtcaccgtctcctcag

SEQ ID NO: 576 - protein, 124 aa, Homo Sapiens
QVQLVQSGGEVKKPRASVKVSCKASGYTFTSYVFSWVRHAAGQGLEWMGWISGYNGNTNYAQKLQCGVSMTADTSTSTAYMELRSLRSDDTAVYFCARSTSYYGAGTLYGMDVWGQGTTVTVSS

SEQ ID NO: 577 - protein, 8 aa, Homo Sapiens
GYTFTSYV

SEQ ID NO: 578 - protein, 8 aa, Homo Sapiens
ISGYNGNT

SEQ ID NO: 579 - protein, 17 aa, Homo Sapiens
ARSTSYYGAGTLYGMDV

SEQ ID NO: 580 - DNA, 373 bp, Homo Sapiens
gaggtgcagctggtggagtctgggggaggtgtggtacggcctggggggtccctgagactctcctgtgcagcctctggattcacctttgatgattatggcatgagctgggtccgccaagctccagggaaggggctggagtgggtctctggtattaattggaatggtggtagcacaggttatgcagactctgtgaagggccgattcaccatctccagagacaacgccaagaactccctgtatctgcaaatgaacagtctgagagccgaggacacggccttgtattactgtgcggccgattactatggttcggggagttattataacgtcccctttgactactggggccagggaaccctggtcaccgtctcctcag

SEQ ID NO: 581 - protein, 124 aa, Homo Sapiens
EVQLVESGGGVVRPGGSLRLSCAASGFTFDDYGMSWVRQAPGKGLEWVSGINWNGGSTGYADSVKGRFTISRDNAKNSLYLQMNSLRAEDTALYYCAADYYGSGSYYNVPFDYWGQGTLVTVSS

SEQ ID NO: 582 - protein, 8 aa, Homo Sapiens
GFTFDDYG

SEQ ID NO: 583 - protein, 8 aa, Homo Sapiens
INWNGGST

SEQ ID NO: 584 - protein, 17 aa, Homo Sapiens
AADYYGSGSYYNVPFDY

SEQ ID NO: 585 - DNA, 373 bp, Homo Sapiens
gaggtgcagctggtggagtctgggggaggtgtgatacggcctggggggtccctgagactctcctgtgcagcctctggattcacctttgatgattatggcatgagctgggtccgccaagctccagggaaggggctggagtgggtctctggtattaattggattggtgataacacagattatgcagactctgtgaagggccgattcaccatctccagagacaacgccaagaactccctatatctgcaaatgaacagtctgagagccgaggacacggccttgtattactgtgcgagagattactttggttcggggagttattataacgttccctttgactactggggccagggaaccctggtcaccgtctcctcag

SEQ ID NO: 586 - protein, 124 aa, Homo Sapiens
EVQLVESGGGVIRPGGSLRLSCAASGFTFDDYGMSWVRQAPGKGLEWVSGINWIGDNTDYADSVKGRFTISRDNAKNSLYLQMNSLRAEDTALYYCARDYFGSGSYYNVPFDYWGQGTLVTVSS

SEQ ID NO: 587 - protein, 8 aa, Homo Sapiens
INWIGDNT

SEQ ID NO: 588 - protein, 17 aa, Homo Sapiens
ARDYFGSGSYYNVPFDY

SEQ ID NO: 589 - DNA, 337 bp, Homo Sapiens
gatattgtgatgactcagtctccactctccctgcccgtcacccctggagagccggcctccatctcctgcaggtctagtcagagcctcctgcatagtaatggattcaactatttcgattggtacctgcagaagccaggacagtctccacagctcctgatctttttggtttctaatcgggcctccggggtccctgacaggttcagtggcagtggatcaggcacagattttacactgaaaatcagcagagtggaggctgaggatgttgggatttattactgcatgcaagctctacaaactccgctcactttcggcggagggaccaaggtggagatcaaac

SEQ ID NO: 590 - protein, 112 aa, Homo Sapiens
DIVMTQSPLSLPVTPGEPASISCRSSQSLLHSNGFNYFDWYLQKPGQSPQLLIFLVSNRASGVPDRFSGSGSGTDFTLKISRVEAEDVGIYYCMQALQTPLTFGGGTKVEIK

SEQ ID NO: 591 - protein, 11 aa, Homo Sapiens
QSLLHSNGFNY

SEQ ID NO: 592 - protein, 3 aa, Homo Sapiens
LVS

SEQ ID NO: 593 - protein, 9 aa, Homo Sapiens
MQALQTPLT

SEQ ID NO: 594 - DNA, 337 bp, Homo Sapiens
gatattgtgatgactcagtctccactctccctgcccgtcacccctggagagccggcctccatctcctgcaggtctagtcagagcctcctgcatagtaatggatacaactgtttggattggtacctgcagaagccagggcagtctccacagctcctgatctatttgggttctactcgggcctccgggttccctgacaggttcagtggcagtggatcaggcacagattttacactgaaaatcagcagagtggaggctgaggatgttggggtttattactgcatgcaagctctacaaactccgtgcagttttggccaggggaccaagctggagatcaaac

SEQ ID NO: 595 - protein, 112 aa, Homo Sapiens
DIVMTQSPLSLPVTPGEPASISCRSSQSLLHSNGYNCLDWYLQKPGQSPQLLIYLGSTRASGFPDRFSGSGSGTDFTLKISRVEAEDVGVYYCMQALQTPCSFGQGTKLEIK

SEQ ID NO: 596 - protein, 11 aa, Homo Sapiens
QSLLHSNGYNC

SEQ ID NO: 597 - DNA, 337 bp, Homo Sapiens; identical to SEQ ID NO: 594

SEQ ID NO: 598 - protein, 112 aa, Homo Sapiens; identical to SEQ ID NO: 595

SEQ ID NO: 599 - DNA, 337 bp, Homo Sapiens
gatattgtgatgactcagtctccactctccctgcccgtcacccctggagagccggcctccatctcctgcaggtctagtcagagcctcctgcatagtaatggatacaactgtttggattggtacctgcagaagccagggcagtctccacagctcctgatctatttgggttctactcgggcctccgggttccctgacaggttcagtggcagtggatcaggcacagattctacactgaaaatcagcagagtggaggctgaggatgttggggtttattactgcatgcaagctctacaaactccgtgcagttttggccaggggaccaagctggagatcaaac

SEQ ID NO: 600 - protein, 112 aa, Homo Sapiens
DIVMTQSPLSLPVTPGEPASISCRSSQSLLHSNGYNCLDWYLQKPGQSPQLLIYLGSTRASGFPDRFSGSGSGTDSTLKISRVEAEDVGVYYCMQALQTPCSFGQGTKLEIK

SEQ ID NO: 601 - DNA, 337 bp, Homo Sapiens; identical to SEQ ID NO: 594

SEQ ID NO: 602 - protein, 112 aa, Homo Sapiens; identical to SEQ ID NO: 595

SEQ ID NO: 603 - DNA, 325 bp, Homo Sapiens
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctttcactttcggccctgggaccaaagtggatatcaaac

SEQ ID NO: 604 - protein, 108 aa, Homo Sapiens
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPFTFGPGTKVDIK

SEQ ID NO: 605 - protein, 9 aa, Homo Sapiens
QQYGSSPFT

SEQ ID NO: 606 - DNA, 325 bp, Homo Sapiens
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggaacctgaagattttgcagtatattactgtcaccagtatggtaattcaccattcactttcggccctgggaccaaagtggatatcaaac

SEQ ID NO: 607 - protein, 108 aa, Homo Sapiens
EIVLTQSPGTLSLSPGERATLSCRASQSVSSSYLAWYQQKPGQAPRLLIYGASSRATGIPDRFSGSGSGTDFTLTISRLEPEDFAVYYCHQYGNSPFTFGPGTKVDIK

SEQ ID NO: 608 - protein, 9 aa, Homo Sapiens
HQYGNSPFT

SEQ ID NO: 609 - protein, 11 aa, Homo Sapiens
  MISC_FEATURE (1)..(1): X = any amino acid.
  MISC_FEATURE (5)..(5): X = any amino acid.
  MISC_FEATURE (8)..(8): X = any amino acid.
  MISC_FEATURE (9)..(9): X = is either present or absent, and if present, may be any amino acid.
XGSGXYGXXFD

SEQ ID NO: 610 - protein, 478 aa, Artificial Sequence
  ICOSL-Fc fusion protein
DTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAATWSDIEGRMDPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

What is claimed is:

1. An isolated antibody that comprises a binding site for the extracellular domain of human ICOS, wherein the antibody comprises a VH domain comprising an amino acid sequence having at least 95% sequence identity to SEQ ID NO: 408 and a VL domain comprising an amino acid sequence having at least 95% sequence identity to SEQ ID NO: 415.

2. An antibody according to claim 1, wherein the VH domain comprises a set of heavy chain complementarity determining regions (HCDRs) HCDR1, HCDR2 and HCDR3, wherein
   HCDR1 has amino acid sequence SEQ ID NO: 405,
   HCDR2 has amino acid sequence SEQ ID NO: 406,
   HCDR3 has amino acid sequence SEQ ID NO: 407.

3. An antibody according to claim 1, wherein the VL domain comprises a set of light chain complementarity determining regions (LCDRs) LCDR1, LCDR2 and LCDR3, wherein
   LCDR1 has amino acid sequence SEQ ID NO: 412,
   LCDR2 has amino acid sequence SEQ ID NO: 413,
   LCDR3 has amino acid sequence SEQ ID NO: 414.

4. An antibody according to claim 1, comprising a VH domain comprising amino acid sequence SEQ ID NO: 408.

5. An antibody according to claim 1, comprising a VL domain comprising amino acid sequence SEQ ID NO: 415.

6. An antibody according to claim 1 which is a human IgG.

7. An antibody according to claim 6 which comprises an effector enabled human IgG1 constant region.

8. An antibody according to claim 7, which is a multispecific antibody comprising a further antigen binding site.

9. An antibody according to claim 8, wherein the further antigen binding site recognizes PD-L1.

10. A composition comprising an antibody according to claim 1 and an anti-PD-L1 antibody.

11. A composition according to claim 10, wherein the anti-PD-L1 antibody is a human IgG.

12. A composition according to claim 11, wherein the anti-PD-L1 antibody comprises an effector enabled human IgG1 constant region.

13. A composition according to claim 11, wherein the anti-PD-L1 antibody comprises a VH domain having amino acid sequence SEQ ID NO: 299 and a VL domain having amino acid sequence SEQ ID NO: 300.

14. A composition according to claim 13, wherein the anti-PD-L1 antibody is an immunocytokine comprising human wild type or variant IL-2.

15. A method of treating cancer in a patient, comprising administering an antibody according to claim 1 to the patient.

16. A method according to claim 15, wherein the cancer is renal cell cancer, head and neck cancer, melanoma, non small cell lung cancer or diffuse large B-cell lymphoma.

17. A method of treating cancer in a patient, comprising administering to the patient
   an antibody that binds the extracellular domain of human ICOS, wherein the antibody is a human IgG1 comprising an effector enabled constant region, and
   an antibody that binds human PD-L1, wherein the antibody is a human IgG1 comprising an effector enabled constant region.

18. A method according to claim 17, wherein the cancer is a renal cell cancer, head and neck cancer, melanoma, non small cell lung cancer or diffuse large B-cell lymphoma.

19. A method according to claim 18, wherein the antibody that binds the extracellular domain of human ICOS and/or the antibody that binds human PD-L1 is a human IgG1 comprising a wild type constant region.

20. A method according to claim 19, wherein the constant region amino acid sequence is SEQ ID NO: 340.

21. A method according to claim 17, wherein said antibody that binds the extracellular domain of human ICOS is administered in a single dose, followed by administration of multiple doses of said antibody that binds human PD-L1.

22. A method of treating cancer in a patient, comprising administering to the patient
   an antibody that binds the extracellular domain of human ICOS and which comprises a VH domain comprising an amino acid sequence having at least 95% sequence identity to SEQ ID NO: 408 and a VL domain comprising an amino acid sequence having at least 95% sequence identity to SEQ ID NO: 415, wherein said antibody is a human IgG1 comprising an effector enabled constant region, and
   an antibody that binds human PD-L1, wherein said antibody is a human IgG1 comprising an effector enabled constant region.

23. A method according to claim 22, wherein said VH domain comprises a set of heavy chain complementarity determining regions (HCDRs) HCDR1, HCDR2 and HCDR3, wherein
   HCDR1 has amino acid sequence SEQ ID NO: 405,
   HCDR2 has amino acid sequence SEQ ID NO: 406,
   HCDR3 has amino acid sequence SEQ ID NO: 407.

24. A method according to claim 22, wherein said VL domain comprises a set of light chain complementarity determining regions (LCDRs) LCDR1, LCDR2 and LCDR3, wherein
   LCDR1 has amino acid sequence SEQ ID NO: 412,
   LCDR2 has amino acid sequence SEQ ID NO: 413,
   LCDR3 has amino acid sequence SEQ ID NO: 414.

25. A method according to claim 23, wherein said VH domain comprises amino acid sequence SEQ ID NO: 408.

26. A method according to claim 24, wherein said VL domain comprises amino acid sequence SEQ ID NO: 415.

* * * * *